United States Patent
Sexton et al.

(10) Patent No.: US 7,329,737 B2
(45) Date of Patent: Feb. 12, 2008

(54) ANTIBODIES THAT BIND HK-1

(75) Inventors: Daniel J. Sexton, Melrose, MA (US);
Andrew Nixon, Hanover, MA (US);
Anthony Williams, Melrose, MA (US);
Robert C. Ladner, Ijamsville, MD
(US); Qi-Long Wu, Brighton, MA (US)

(73) Assignee: Dyax Corp., Cambridge, MA (US)

( * ) Notice: Subject to any disclaimer, the term of this patent is extended or adjusted under 35 U.S.C. 154(b) by 73 days.

(21) Appl. No.: 11/196,627

(22) Filed: Aug. 3, 2005

(65) Prior Publication Data

US 2007/0004910 A1    Jan. 4, 2007

Related U.S. Application Data

(60) Provisional application No. 60/615,721, filed on Oct. 4, 2004, provisional application No. 60/598,506, filed on Aug. 3, 2004.

(51) Int. Cl.
*C07K 16/00* (2006.01)
*C07K 16/24* (2006.01)
*A61K 39/395* (2006.01)

(52) U.S. Cl. .............................. 530/388.25; 530/388.1; 530/388.23; 424/130.1; 424/141.1; 424/145.1

(58) Field of Classification Search ...................... None
See application file for complete search history.

(56) References Cited

U.S. PATENT DOCUMENTS 6,472,195 B2 * 10/2002 Hillman et al. ............. 435/226

FOREIGN PATENT DOCUMENTS

| JP | 2003-252792 | 9/2003 |
|---|---|---|
| WO | WO00/23100 | 4/2000 |
| WO | WO2004/029238 | 4/2004 |
| WO | WO2006-008002 | 1/2006 |

OTHER PUBLICATIONS

Rudikoff et al. PNAS 1982, 79:1979.*
Kashmiri et al. 2005, Methods, 36:25-34.*
Ole-Moiyoi et al. 1978, Journal of Immunology, 121:66-71.*
Pimenta et al. 2002, Biol Chem, 383:853-857.*
Bendig et al. Mehods, 1995, 8:83-93.*
Bourgeois et al., "Serpin-derived Peptide Substrates for Investigating the Substrate Specificity of Human Tissue Kallikreins hK1 and hK2", (1997) J. Biol. Chemistry 272:29590-29595.
Carmeliet and Jain, "Angiogenesis in cancer and other diseases", (2000) Nature, 407:249-257.
Casalino-Matsuda et al., "Role of Hyaluronan and Reactive Oxygen Species in Tissue Kallikrein-mediated Epidermal Growth Factor Receptor Activation in Human Airways", (2004) J. Biol. Chem, 279(20):21606-21616.
Chan et al., "Expression and Characterization of Human Tissue Kallikrein Variants", (1998) Protein Expr Purif, 12(3):p. 361-370.
Christiansen et al., "Elevation of Tissue Kallikrein and Kinin in the Airways of Asthmatic Subjects after Endobronchial Allergen Challenge", (1992) Am Rev Respir Dis, 145(4 Pt 1):900-905.
Christiansen et al., "Detection of Tissue Kallikrein in the Bronchoalveolar Lavage Fluid of Asthmatic Subjects", (1987) J. Clin. Invest, 79(1):188-197.
Henderson et al., "The Importance of Leukotrienes in Airway Inflammation in a Mouse Model of Asthma", (1996) J. Exp. Med., 184:1483-1494.
Iris et al., "Human Urinary Prokallikrein: Rapid Purification and Model Activation by Trypsin", (1986) Biochem. Int. 13, 375-382.
Kizuki et al., "An Inactive Form of Kallikrein in Human Urine", (1986) Adv Exp Med Bio, 198 Pt A:329-337.
Lauredo et al., "Leukocytic cell sources of airway tissue kallikrein", (2004) Am J Physiol Lung Cell Mol Physiol, 286(4):L734-740.
Murthy et al., "Purification and Characterization of Canine Urinary Kallikrein", (1986) Arch Biochem Biophys, 244(2):563-571.
Proud et al., "Localization of Immunoreactive Tissue Kallikrein in Human Trachea", (1993) Am J. Respir Cell Mol Biol, 8(1):16-19.
Stell et al., "Isolation and Partial Characterization of Rabbit Urinary Kallikrein", (1989) Adv Exp Med Biol, 247B:195-200.
Takaoka et al., "Purification to Apparent Homogeneity of Inactive Kallikrein from Rat Urine", (1984) Biochem Biophys Res Commun, 122(3):1282-1288.
Yousef et al., "The New Human Tissue Kallikrein Gene Family: Structure, Function, and Association to Disease", (2001) Endocrine Reviews 22:184-204.
Austin, Suzanne, "Drug Discovery Technology Europe 2005—IBC's Ninth Annual Conference and Exhibition", London, UK, Mar. 15-17, *The Investigational Drugs Journal*, vol. 8, No. 5., pp. 370-373 (2005).
Hoet et al., "Generation of High-Affinity Human Antibodies by Combining Donor-Derived and Synthetic Complementary-Determining-Region Diversity", *Nature Biotechnology*, vol. 23,No. 3, pop. 344-348, (Mar. 2005).
Pinkus et al., "Immunohistochemical Localization of Glandular Kallikrein in the Endocrine and Exocrine Human Pancreas", *The Journal of Histochemistry and Cytochemistry*, vol. 31, No. 11, pp. 1279-1288, (1983).
Savoy-Moore et al., "Characterization of Monoclonal Antibodies Against Rat Glandular Kallikrein", *Journal of Immunological Methods*, 88: pp. 45-51, (1986).
Sexton et al., "Antibody inhibitors of airway tissue kallikrein 1", *J. Immunol.* 176, Suppl. S, p. S286 (Apr. 2006) and *Ann. Meeting of the Am. Assoc. Immunol.* May 2006.
Silver et al., "Active Site Radioimmunoassay for Human Urokallikrein and Demonstration by Radioimmunoassay of a Latent Form of the Enzyme", *The Journal of Immunology*, vol. 124, No. 4, pp. 1551-1555, (Apr. 1980).

(Continued)

Primary Examiner—Phillip Gambel
Assistant Examiner—Sharon Wen
(74) Attorney, Agent, or Firm—Fish & Richardson P.C.

(57) ABSTRACT

The invention features hK1 binding polypeptides as well as compositions comprising such polypeptides and methods of making and using such polypeptides.

17 Claims, 9 Drawing Sheets

OTHER PUBLICATIONS

Wassaf et al., "High-throughput affinity ranking of antibodies using surface plasmon resonance microarrays," *Anal. Biochem.* vol. 351 (2):241-53, Apr. 2006.

International Search Report, the Written Opionion, and International Preliminary Report on Patentability for PCT/US2005/027493 dated Sep. 3, 2007.

* cited by examiner

ANTIBODIES THAT BIND HK-1

This application claims priority to U.S. Application Ser. No. 60/598,506, filed on Aug. 3, 2004, and U.S. Application No. 60/615,721, file Oct. 4, 2004, the contents of which are hereby incorporated by reference.

SUBMISSIONS ON COMPACT DISC

This application incorporates by reference ASCII text file identified by the name 10280-090001.txt, containing 601 KB of data, and created on Nov. 28, 2005, filed in computer-readable format (CRF) and encoded on the CD-ROM.

BACKGROUND

Human tissue kallikreins include hK1, a protein encoded by the KLK1 gene and sometimes referred to as pancreatic/renal kallikrein, hPRK, or GenBank® M25629 or M33105. See generally Yousef et al. (2001) Endocrine Reviews 22:184-204.

SUMMARY

This disclosure provides, inter alia, hK1 binding proteins. An "hK1 binding protein" refers to a protein that can interact with hK1 or a fragment thereof, particularly a protease-active fragment thereof. The hK1 binding proteins include antibodies that bind to hK1 with high affinity and antibody that can inhibit hK1 enzymatic activity. HK1 binding proteins can be administered to a subject, e.g., to treat disorders such as asthma (e.g., allergic and non-allergic asthma), chronic obstructive pulmonary disease (COPD), multiple sclerosis, psoriasis, rheumatoid arthritis, osteoarthritis, rhinitis, sinusitus, inflammatory bowel diseases (such as Crohn's disease and ulcerative colitis), immune mediated diabetes, acute pancreatitis, interstitial cystitis, and a neoplastic disorder (e.g., metastatic pancreatic adenocarcinomas or tumor angiogenesis), or other hK1-associated disorders.

In one aspect, the disclosure features a protein that binds to hK1 and that includes a heavy chain immunoglobulin variable domain sequence and a light chain immunoglobulin variable domain sequence. The protein can bind to or sterically occlude the active site of hK1. In one embodiment, the protein contacts one or more of the hK1 active site residues 65, 120, or 214, or a residue within five amino acids of such residues. In one embodiment, the protein inhibits hK1 enzymatic activity. For example, the protein can inhibit hK1 with an IC50 of less than 200, 80, 50, 40, 30, 20, 10, 5,4, 3, 2.5 or 1 nM, e.g., an IC50 of between 1 and 20 nM, and other ranges therebetween. The protein may bind to hK1 with a Kd of less than than $10^{-7}$ M, $10^{-8}$ M, $5 \cdot 10^{-9}$ M, $10^{-9}$ M, $10^{-10}$ M, $10^{-11}$ M, or $10^{-12}$ M, e.g., a Kd of between $10^{-8}$ M and $10^{-11}$ M, and other ranges therebetween.

In one embodiment, the protein prevents hK1 from interacting with a protein substrate larger than 12 amino acids, e.g., high molecular weight kininogen, low molecular weight kininogen, epidermal growth factor, pro-insulin, low density lipoprotein, , prorenin, vasoactive intestinal peptide, procollagenase, and/or angiotensinogen. In another embodiment, the protein prevents hK1 from interacting with a peptide substrate smaller than 12 amino acids.

In one embodiment, the protein is unable to bind an hK1 molecule that is inactivated by aprotinin or other protein protease inhibitors such as α1-antitrypsin or kallistatin.

In one embodiment, the protein does not evoke an immunogenic response in humans. For example, the protein is a humanized antibody, a human antibody, or an effectively human antibody. In one embodiment, the protein includes one or more human CDRs, e.g., at least three, four, five, or six human CDRs. In one embodiment, the protein includes one or more of the CDRs described herein, e.g., one or more of the CDRs of SEQ ID NOs: 1-30, 33-41, 45-77, 79, 81-85, 87-89, 91-95, 97-102, 106-107, 111-113, 115-121, 123-126, 128-138, 141-143, 147, 149-151, 153-157, 159-161, 163-174, 177-178, 180-181, 183-219, 223-231, 233-241, 243-253, 255-257, 259, 261-264, 267-277, 279-281, 283, 285-295, 297-313, 315-317, 319-323, 325-335, 337-339, 341-342, 345-353, 355-361, 363-365, 367-397, 399-413, 415, 417-419, 421-425, 427-431, 433, 435-445, 447-463, 465-498, 501-505, 507-535, 537-539, 541-557, 559, 561-563, 565-570, 573-577, 579-594, 597-601, 603-605, 607-620, 622-630, 633-659, 661-677, 679-701, 703-713, 715-720, 723-757, 759-767, 769-785, 787-803, 806-812, 814-822, 825-829, 831-835, 837-846, 849-857, 861-865, 867-875, 877-882, 885-893, 895-900, 903-917, 919, 921-949, 951-954, 956-961, 963-967, 969-973, 975-997, 999-107, 109, 1011-1020 and 318, 301, 302, 307, 308 and 312. In one embodiment, the protein includes one or more, e.g., three, four, five six CDRs, of SEQ ID NOs: 7, 8, 9, 10, 11 and 12. In another embodiment, the protein includes one or more, e.g., three, four, five or six CDRs, of SEQ ID NOs: 318, 301, 302, 307, 308 and 312. In another embodiment, the protein includes one or more, e.g., three, four, five six CDRs, of SEQ ID NOs: 91, 92, 111, 112, 113 and 6. In another embodiment, the protein includes one or more, e.g., three, four, five six CDRs, of SEQ ID NOs: 151, 128, 153, 154, 155 and 156. In one embodiment, the protein includes one or more human framework regions or substantially human framework regions, e.g., at least three, four, five, or six human framework regions. In one embodiment, the protein includes one or more framework regions from the variable heavy chains having the amino acid sequence of SEQ ID NOs: 1199-1296 and 222, 324, 336, 340, 343, 344, 354, 362, 366, 398, 414, 420, 426, 432, 434, 446, 464, 499, 500, 506, 436, 540, 558, 560, 564, 571, 572, 578, 595, 596, 602, 606, 621, 631, 632, 660, 678, 702, 714, 721, 722, 758, 768, 786, 804, 813, 823, 824, 830, 836, 847, 848, 858, 859, 860, 866, 876, 883, 884, 894, 901, 902, 918, 920, 950, 955, 962, 968, 974, 998, 1008, 1010 and 152 and/or one or more framework regions from the variable light chains having the amino acid sequence of SEQ ID NOs: 1022-1198 and 148. In one embodiment, the protein includes one or more framework region from the variable heavy chain sequence of SEQ IDNO:1245 and/or one or more framework region from the variable light chain sequence of SEQ ID NO:1070. In another embodiment, the protein includes one or more framework region from the variable heavy chain sequence of SEQ IDNO:1206 and/or one or more framework region from the variable light chain sequence of SEQ ID NO:1029. In another embodiment, the protein includes one or more framework region from the variable heavy chain sequence of SEQ IDNO:860 and/or one or more framework region from the variable light chain sequence of SEQ ID NO:1183.

HC CDR1 can include an amino acid sequence having a length of at least 5 amino acids of which at least 3, 4, or 5 amino acids are identical to the HC CDR1 sequence of an antibody described herein, e.g., the HC CDR1 of SEQ ID NOs:10, 112, 154 or 307.

HC CDR2 can include an amino acid sequence having a length of at least 15, 16, or 17 amino acids of which at least 10, 12, 14, 15, 16, or 17 amino acids are identical to the HC CDR2 sequence of an antibody described herein, e.g., the HC CDR2 of SEQ ID NOs:11, 113, 155 or 308. HC CDR2 can include an amino acid sequence having a length of at least 17 amino acids of which at least 14, 15, 16, or 17 amino acids are identical to the HC CDR2 sequence of an antibody described herein, e.g., the HC CDR2 of SEQ ID NOs:11, 113, 115 or 308.

HC CDR3 can include an amino acid sequence having a length of at least 7 or 8 amino acids of which at least 5, 6, 7, or 8 amino acids are identical to the HC CDR3 sequence of an antibody described herein, e.g., the HC CDR3 of SEQ ID NOs: 12, 6, 156 or 312.

LC CDR1, CDR2, and/or CDR3 can include amino acid sequences that are identical to, or differ by fewer than two amino acids for every ten amino acids in length from, a corresponding LC CDR sequence of an antibody described herein, e.g., the LC CDR1 of SEQ ID NOs:7, 91, 151 or 318, the LC CDR2 of SEQ ID NOs:8, 92, 128 or 301, the LC CDR3 of SEQ ID NO:9, 111, 153 or 302.

In one embodiment, the H1 and H2 hypervariable loops have the same canonical structure as an antibody described herein. In one embodiment, the L1 and L2 hypervariable loops have the same canonical structure as an antibody described herein.

In one embodiment, the amino acid sequence of the HC variable domain sequence is at least 70, 80, 85, 90, 92, 95, 97, 98, 99, or 100% identical to the amino acid sequence of the HC variable domain of an antibody described herein, e.g., the HC variable domain of SEQ ID NOs: 1206, 1245 or 860. In one embodiment, the amino acid sequence of the LC variable domain sequence is at least 70, 80, 85, 90, 92, 95, 97, 98, 99, or 100% identical to the amino acid sequence of the LC variable domain of an antibody described herein, e.g., the LC variable domain of SEQ ID NOs: 1029, 1070 or 1183. For example, the amino acid sequences of the HC and LC variable domain sequences are at least 70, 80, 85, 90, 92, 95, 97, 98, 99, or 100% identical to the amino acid sequences of the HC and LC variable domains an antibody described herein, e.g., the HC variable domain of SEQ ID NO:1245 and the light chain variable domain of SEQ ID NO:1070, the HC variable domain of SEQ ID NO:1206 and the light chain variable domain of SEQ ID NO:1029, the HC variable domain of SEQ ID NO:860 and the light chain variable domain of SEQ ID NO:1183.

The amino acid sequences of the HC and LC variable domain sequences can be encoded by a sequence that hybridizes under high stringency conditions to a nucleic acid sequence described herein or one that encodes a variable domain or to a nucleic acid encoding an amino acid sequence described herein, e.g., an amino acid sequence of SEQ ID NO:1245 and/or SEQ ID NO:1070, SEQ ID NO:1206 and/or SEQ ID NO:1029, SEQ ID NO:860 and/or SEQ ID NO:1183. In one embodiment, the amino acid sequences of one or more framework regions (e.g., FR1, FR2, FR3, and/or FR4) of the HC and/or LC variable domain are at least 70, 80, 85, 90, 92, 95, 97, 98, 99, or 100% identical to corresponding framework regions of the HC and LC variable domains of an antibody described herein, e.g., an amino acid sequence of SEQ ID NO:1245 and SEQ ID NO:1070, SEQ ID NO: 1206 and SEQ ID NO:1029, SEQ ID NO:860 and SEQ ID NO:1183. In one embodiment, one or more heavy chain framework regions (e.g., HC FR1, FR2, and FR3) are at least 70, 80, 85, 90, 95, 96, 97, 98, or 100% identical to the sequence of corresponding framework regions from a human germline antibody, e.g., a VHIII germline antibody or a germline antibody sequence that is compatible with a 1-3 canonical structure in the H1 and H2 hypervariable loops.

In one embodiment, one or more light chain framework regions are at least 80, 85, 90, 95, 96, 97, 98, or 100% identical to the sequence of corresponding framework regions for a human germline antibody.

In one embodiment, the heavy chain variable domain sequence forms a variable domain having the 1-3 Chothia canonical structure for the H1 and H2 hypervariable loops.

HC CDR3 can include R-(RV)-G-X-(WY)-(YG)-(AGS)-(FM)-D-(YIV)-W (SEQ ID NO:232). HC CDR3 can include Y-(YP)-Y-(YG)-(AG)-(MF)-D-(VI) (SEQ ID NO:242). LC CDR1 can include (RG)-A-S-(QS)-S-(IV)-(SG)-(SG)-Y-(LY)-(NA) (SEQ ID NO:254). LC CDR1 can include (RGV)-A-S-(QS)-S-(IV)-(SG)-(ST)-(YN)-L-(NA) (SEQ ID NO:258). LC CDR1 can include R-A-S-Q-X-I-(SG)-(SLG)-X-(LY) (SEQ ID NO:260). LC CDR2 can include I-Y-(AG)-(AV)-S-(NS)-(RL)-(PA)-S-G-(VI) (SEQ ID NO:265). LC CDR2 can include I-Y-(AG)-(AV)-S-S-(RL)-(PAQ)-(ST)-G-(VI) (SEQ ID NO:266). LC CDR3 can include Q-Q-(YS)-(TANGY)-S-(SPT)-(PS)-X-T-F (SEQ ID NO:278). LC CDR3 can include (CA)-Q-(QW)-(YD)-D-S-L-P-X-T-F (SEQ ID NO:282)or (CA)-Q-(QW)-(YD)-D-S-L-P-G-T-F (SEQ ID NO:296). Amino acids provided in parentheses indicate alternatives at a given position.

In one embodiment, the protein binds all or part of an epitope bound by an antibody described herein, e.g., a DX-2300, M093-F09, M137-E01 and M0097-B12 antibody. The protein can inhibit, e.g., competitively inhibit, the binding of an antibody described herein, e.g., a DX-2300, M093-F09, M137-E01 and M0097-B12 antibody, to hK1. A protein may bind an epitope, e.g., a conformational or linear epitope,which epitope when bound prevents binding of an antibody described herein, e.g., a DX-2300, M093-F09, M137-E01 and M0097-B12 antibody, to hK1. The epitope can be in close proximity spacially or functionally-associated, e.g., an overlapping or adjacent epitope in a linear sequence or conformational space, to the one recognized by an antibody described herein, e.g., a DX-2300, M093-F09, M137-E01 and M0097-B12 antibody.

The protein can be a full-length antibody (e.g., an IgG (e.g., an IgG1, IgG2, IgG3, IgG4), IgM, IgA (e.g., IgA1, IgA2), IgD, and IgE, but preferably an IgG) or can include only an antigen-binding fragment (e.g., a Fab, F(ab')$_2$ or scFv fragment, or one or more CDRs). An antibody, or antigen-binding fragment thereof, can include two heavy chains and two light chains, or can be a single chain antibody. The antibodies can, optionally, include a constant region chosen from a kappa, lambda, alpha, gamma, delta, epsilon or a mu constant region gene. A preferred antibody includes a heavy and light chain constant region substantially from a human antibody, e.g., a human IgG1 constant region, a portion thereof, or a consensus sequence.

In one embodiment, the hK1 binding protein binds hK1 and inhibits or reduces the hK1 catalytic activity of hK1. In one embodiment, the hK1 binding protein can have a Ki for hK1, of less than 50 nM, 40 nM, 30 nM, 20 nM, 5 nM, 1 nM, 500 pM, 100 pM, 50 pM, 30 pM. The hK1 binding protein can preferentially inhibit hK1 enzyme activity at least 100, 200, 500, or 1000 more than another protease.

The disclosure also features nucleic acids that encodes each of the polypeptides described herein. The nucleic acid can include the cognate codons or any set of codons that can be translated to produce the respective polypeptide. For example, the nucleic acid can include one or more codon that is a common codon that can be translated to produce the respective polypeptide and is common for the type of cell in which it is expressed. In one embodiment, the nucleic acid includes at least 40%, 50%, 60%, 70%, 80%, 90%, 95%, 99% or more common codons for the type of cell in which the encoded polypeptide is expressed. In one embodiment, the nucleic acid encodes the heavy chain sequence of SEQ ID NO:1245 and/or the light chain sequence of SEQ ID NO:1070, the heavy chain sequence of SEQ ID NO:1206 and/or the light chain sequence of SEQ ID NO:1029, the heavy chain sequence of SEQ ID NO:860 and/or the light chain sequence of SEQ ID NO:1183. In one embodiment, the nucleic acid encodes the heavy chain sequence of SEQ ID NO:1245 and one or more of the codons is a common codon, e.g., for expression in Chinese hamster ovary (CHO) cells, e.g., the nucleic acid includes the nucleotide sequence of SEQ ID NO:146. In one embodiment, the nucleic acid encodes the light chain sequence of SEQ ID NO:1070 and one or more of the codons is a common codon, e.g., for expression in Chinese hamster ovary (CHO) cells, e.g., the nucleic acid includes the nucleotide sequence of SEQ ID NO:145. In addition, the invention features a host cell that includes a nucleic acid described herein.

In yet another aspect, the invention features a method of producing an hK1-binding antibody, or antigen-binding fragment thereof. The method includes: providing a host cell that contains a first nucleic acid sequence encoding a polypeptide including a heavy chain variable region, e.g., a heavy chain variable region as described herein; providing a second nucleic acid sequence encoding a polypeptide including a light chain variable region, e.g., a light chain variable region as described herein; and expressing said first and second nucleic acid sequences in the host cell under conditions that allow assembly of said light and heavy chain variable regions to form an antigen binding protein that interacts with hK1. The first and second nucleic acid sequences can be linked or unlinked, e.g., expressed on the same or different vector, respectively. The first and second nucleic acid sequences can be components of the same molecule or can reside on different molecules (e.g., different chromosomes or plasmids).

The host cell can be a eukaryotic cell, e.g., a mammalian cell, an insect cell, a yeast cell, or a prokaryotic cell, e.g., *E. coli*. For example, the mammalian cell can be a cultured cell or a cell line. Exemplary mammalian cells include lymphocytic cell lines (e.g., NSO), CHO, COS cells, oocyte cells, and cells from a transgenic animal, e.g., mammary epithelial cell. For example, nucleic acids encoding the antibodies described herein can be expressed in a transgenic animal. In one embodiment, the nucleic acids are placed under the control of a tissue-specific promoter (e.g., a mammary specific promoter) and the antibody is produced in the transgenic animal. For example, the antibody molecule is secreted into the milk of the transgenic animal, such as a transgenic cow, pig, horse, sheep, goat or rodent.

The disclosure also features a method of ameliorating an hK1-associated disorder. The method includes: administering a hK1 binding protein (e.g., as described herein) to a subject in an amount effective to ameliorate the disorder or at least one symptom thereof. The disorder can be an inflammatory disorder. The disorder can be, e.g., COPB, asthma, rheumatoid arthritis, osteoarthritis, multiple sclerosis. The disorder can be rhinitis, sinusitus, inflammatory bowel diseases (such as Crohn's disease and ulcerative colitis), immune mediated diabetes, acute pancreatitis, interstitial cystitis, or a neoplastic disorder (e.g., metastatic pancreatic adenocarcinomas or tumor angiogenesis). The protein can include other features described herein. Generally the protein includes an antigen binding site that includes a light chain (LC) variable domain sequence and a heavy chain (HC) variable domain sequence. The protein can be in the form of an IgG or a Fab. Typically, the protein is not immunogenic in the subject, e.g., the protein includes human or effectively human frameworks and constant domains, e.g., a modified human constant domain. In one embodiment, the protein inhibits hK1. The method can include other features described herein.

The disclosure also features a method of preventing or treating an hK1-associated disorder. The method includes: administering a hK1 binding protein (e.g., as described herein) to a subject in an amount effective to prevent or treat the disorder, delay the onset of at least one symptom thereof, or ameliorate at least one symptom thereof. For example, the disorder is: asthma (e.g., allergic and non-allergic asthma), chronic obstructive pulmonary disease (COPD), multiple sclerosis, psoriasis, rheumatoid arthritis, osteoarthritis, rhinitis, sinusitus, inflammatory bowel diseases (such as Crohn's disease and ulcerative colitis), immune mediated diabetes, acute pancreatitis, interstitial cystitis, or a neoplastic disorder (e.g., metastatic pancreatic adenocarcinomas or tumor angiogenesis). The protein can include other features described herein. Generally the protein includes an antigen binding site that includes a light chain (LC) variable domain sequence and a heavy chain (HC) variable domain sequence. The protein can be in the form of an IgG or a Fab. Typically, the protein is not immunogenic in the subject, e.g., the protein includes human or effectively human frameworks and constant domains, e.g., a modified human constant domain. In one embodiment, the protein inhibits hK1. The method can include other features described herein.

The disclosure also features a method of modulating airway inflammation or airway hyperresponsivenes in a subject. The method includes: administering a hK1 binding protein (e.g., as described herein) to a subject in an amount effective to (i) reduce bronchial tissue kallikrein activity, (ii) to reduce airway inflammation in the subject, and/or (iii) to reduce airway hyperresponsiveness in the subject. In one embodiment, the protein is administered by inhalation, e.g., using a metered dose inhaler. In another embodiment, the protein is administered by subcutaneous injection.

In another aspect, the disclosure features method of preventing or treating an angiogenesis-associated disorder. The method includes: administering a hK1 binding protein (e.g., as described herein) to a subject in an amount effective to reduce angiogenesis and/or ameliorate an angiogenesis-associated disorder, e.g., a neoplastic disorder. For example, the disorder is a neoplastic disorder characterized by malignant tumor growth. The protein can be administered by a variety of methods, e.g, by injection, e.g., subcutaneously, intramuscularly, or intravenously. In one embodiment, the protein is administered locally to a tumor.

The hK1 binding protein (the first agent) can be administered in combination with a second agent that is effective for treating a neoplastic disorder. For example, the second agent modulates activity of a VEGF class growth factor, e.g., the second agent modulates activity of a VEGF or a VEGF receptor. In one embodiment, the second agent is an antibody that binds to VEGF. Other examples of second agents are provided herein.

As used herein, "administered in combination" means that two or more agents are administered to a subject at the same time or within an interval, such that there is overlap of an effect of each agent on the patient. Preferably, the administrations of the first and second agent are spaced sufficiently close together such that a combinatorial effect is achieved.

The interval can be an interval of minutes, hours, days or weeks. Generally, the agents are concurrently bioavailable, e.g., detectable, in the subject. The first and second agents can be administered in either order. In a preferred embodiment at least one administration of one of the agents, e.g., the first agent, is made within minutes, one, two, three, or four hours, or even within one or two days of the other agent, e.g., the second agent.

In one embodiment, the first and second agents are administered at the same time. For example, the first and second agents are co-formulated. In another embodiment, the first and second agents are administered at different times.

The protein can include other features described herein. Generally the protein includes an antigen binding site that includes a light chain (LC) variable domain sequence and a heavy chain (HC) variable domain sequence. The protein can be in the form of an IgG or a Fab. Typically, the protein is not immunogenic in the subject, e.g., the protein includes human or effectively human frameworks and constant domains, e.g., a modified human constant domain. In one embodiment, the protein inhibits hK1. The method can include other features described herein.

Definitions

As used herein, the term "antibody" refers to a protein that includes at least one immunoglobulin variable domain or immunoglobulin variable domain sequence. For example, an antibody can include a heavy (H) chain variable region (abbreviated herein as VH), and a light (L) chain variable region (abbreviated herein as VL). In another example, an antibody includes two heavy (H) chain variable regions and two light (L) chain variable regions. The term "antibody" encompasses antigen-binding fragments of antibodies (e.g., single chain antibodies, Fab fragments, F(ab')$_2$, a Fd fragment, a Fv fragments, and dAb fragments) as well as complete antibodies.

The VH and VL regions can be further subdivided into regions of hypervariability, termed "complementarity determining regions" ("CDR"), interspersed with regions that are more conserved, termed "framework regions" (FR). The extent of the framework region and CDR's has been precisely defined (see, Kabat, E. A., et al. (1991) *Sequences of Proteins of Immunological Interest, Fifth Edition*, U.S. Department of Health and Human Services, NIH Publication No. 91-3242, and Chothia, C. et al. (1987) J. Mol. Biol. 196:901-917). Kabat definitions are used herein. Each VH and VL is typically composed of three CDR's and four FR's, arranged from amino-terminus to carboxy-terminus in the following order: FR1, CDR1, FR2, CDR2, FR3, CDR3, FR4.

An "immunoglobulin domain" refers to a domain from the variable or constant domain of immunoglobulin molecules. Immunoglobulin domains typically contain two β-sheets formed of about seven β-strands, and a conserved disulphide bond (see, e.g., A. F. Williams and A. N. Barclay 1988 *Ann. Rev Immunol.* 6:381-405). The canonical structures of hypervariable loops of an immunoglobulin variable can be inferred from its sequence, as described in Chothia et al. (1992) *J. Mol. Biol.* 227:799-817; Tomlinson et al. (1992) *J. Mol. Biol.* 227:776-798); and Tomlinson et al. (1995) EMBO J. 14(18):4628-38.

As used herein, an "immunoglobulin variable domain sequence" refers to an amino acid sequence which can form the structure of an immunoglobulin variable domain. For example, the sequence may include all or part of the amino acid sequence of a naturally-occurring variable domain. For example, the sequence may omit one, two or more N- or C-terminal amino acids, internal amino acids, may include one or more insertions or additional terminal amino acids, or may include other alterations. In one embodiment, a polypeptide that includes immunoglobulin variable domain sequence can associate with another immunoglobulin variable domain sequence to form a target binding structure (or "antigen binding site"), e.g., a structure that interacts with hK1, e.g., binds to or inhibits hK1.

The VH or VL chain of the antibody can further include all or part of a heavy or light chain constant region, to thereby form a heavy or light immunoglobulin chain, respectively. In one embodiment, the antibody is a tetramer of two heavy immunoglobulin chains and two light immunoglobulin chains, wherein the heavy and light immunoglobulin chains are inter-connected by, e.g., disulfide bonds. The heavy chain constant region includes three domains, CH1, CH2 and CH3. The light chain constant region includes a CL domain. The variable region of the heavy and light chains contains a binding domain that interacts with an antigen. The constant regions of the antibodies typically mediate the binding of the antibody to host tissues or factors, including various cells of the immune system (e.g., effector cells) and the first component (Clq) of the classical complement system. The term "antibody" includes intact immunoglobulins of types IgA, IgG, IgE, IgD, IgM (as well as subtypes thereof). The light chains of the immunoglobulin may be of types kappa or lambda. In one embodiment, the antibody is glycosylated. An antibody can be functional for antibody-dependent cytotoxicity and/or complement-mediated cytotoxicity.

One or more regions of an antibody can be human or effectively human. For example, one or more of the variable regions can be human or effectively human. For example, one or more of the CDRs can be human, e.g., HC CDR1, HC CDR2, HC CDR3, LC CDR1, LC CDR2, and LC CDR3. Each of the light chain CDRs can be human. HC CDR3 can be human. One or more of the framework regions can be human, e.g., FR1, FR2, FR3, and FR4 of the HC or LC. In one embodiment, all the framework regions are human, e.g., derived from a human somatic cell, e.g., a hematopoietic cell that produces immunoglobulins or a non-hematopoietic cell. In one embodiment, the human sequences are germline sequences, e.g., encoded by a germline nucleic acid. One or more of the constant regions can be human or effectively human. In another embodiment, at least 70, 75, 80, 85, 90, 92, 95, or 98% of the framework regions (e.g., FR1, FR2, and FR3, collectively, or FR1, FR2, FR3, and FR4, collectively) or the entire antibody can be human or effectively human. For example, FR1, FR2, and FR3 collectively can be at least 70, 75, 80, 85, 90, 92, 95, 98, or 99% identical to a human sequence encoded by a human germline VH segment.

All or part of an antibody can be encoded by an immunoglobulin gene or a segment thereof. Exemplary human immunoglobulin genes include the kappa, lambda, alpha (IgA1 and IgA2), gamma (IgG1, IgG2, IgG3, IgG4), delta, epsilon and mu constant region genes, as well as the myriad immunoglobulin variable region genes. Full-length immunoglobulin "light chains" (about 25 Kd or 214 amino acids) are encoded by a variable region gene at the NH2-terminus (about 110 amino acids) and a kappa or lambda constant region gene at the COOH-terminus. Full-length immunoglobulin "heavy chains" (about 50 Kd or 446 amino acids), are similarly encoded by a variable region gene (about 116 amino acids) and one of the other aforementioned constant region genes, e.g., gamma (encoding about 330 amino acids).

The term "antigen-binding fragment" of a full length antibody (or simply "antibody portion," or "fragment"), as used herein, refers to one or more fragments of a full-length antibody that retain the ability to specifically bind to a target of interest. Examples of binding fragments encompassed within the term "antigen-binding fragment" of a full length antibody include (i) a Fab fragment, a monovalent fragment consisting of the VL, VH, CL and CH1 domains; (ii) a F(ab')$_2$ fragment, a bivalent fragment including two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR) that retains functionality. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules known as single chain Fv (scFv). See e.g., Bird et al. (1988) *Science* 242:423-426; and Huston et al. (1988) *Proc. Natl. Acad. Sci. USA* 85:5879-5883.

Antibody fragments can be obtained using any appropriate technique including conventional techniques known to those with skill in the art. The term "monospecific antibody" refers to an antibody that displays a single binding specificity and affinity for a particular target, e.g., epitope. This term includes a "monoclonal antibody" or "monoclonal antibody composition," which as used herein refer to a preparation of antibodies or fragments thereof of single molecular composition. As used herein, "isotype" refers to the antibody class (e.g., IgM or IgG1) that is encoded by heavy chain constant region genes.

An "effectively human" immunoglobulin variable region is an immunoglobulin variable region that includes a sufficient number of human framework amino acid positions such that the immunoglobulin variable region does not elicit an immunogenic response in a normal human. An "effectively human" antibody is an antibody that includes a sufficient number of human amino acid positions such that the antibody does not elicit an immunogenic response in a normal human.

A "humanized" immunoglobulin variable region is an immunoglobulin variable region that is modified to include a sufficient number of human framework amino acid positions such that the immunoglobulin variable region does not elicit an immunogenic response in a normal human. Descriptions of "humanized" immunoglobulins include, for example, U.S. Pat. No. 6,407,213 and U.S. Pat. No. 5,693,762.

As used herein, "binding affinity" refers to the apparent association constant or $K_a$. The $K_a$ is the reciprocal of the dissociation constant ($K_d$). A binding protein may, for example, have a Kd of less than $10^{-5}$, $10^{-6}$, $10^{-7}$ or $10^{-8}$ M for a particular target molecule. Higher affinity binding of a binding ligand to a first target relative to a second target can be indicated by a higher $K_a$ (or a smaller numerical value $K_d$) for binding the first target than the $K_a$ (or numerical value $K_d$) for binding the second target. In such cases the binding protein has specificity for the first target (e.g., hK1) relative to the second target (e.g., a protein other than hK1, e.g., serum albumin, laminin, or a globin). Differences in binding affinity (e.g., for specificity or other comparisons) can be at least 1.5, 2, 3, 4, 5, 10, 15, 20, 50, 70, 80, 100, 500, 1000, or $10^5$ fold.

Binding affinity can be determined by a variety of methods including equilibrium dialysis, equilibrium binding, gel filtration, ELISA, surface plasmon resonance, or spectroscopy (e.g., using a fluorescence assay). Exemplary conditions for evaluating binding affinity are in PBS (phosphate buffered saline) at pH 7.2 at 30° C. These techniques can be used to measure the concentration of bound and free binding protein as a function of binding protein (or target) concentration. The concentration of bound binding protein ([Bound]) is related to the concentration of free binding protein ([Free]) and the concentration of binding sites for the binding protein on the target where (N) is the number of binding sites per target molecule by the following equation:

$$[Bound]=N\cdot[Free]/((1/Ka)+[Free]).$$

It is not always necessary to make an exact determination of Ka, though, since sometimes it is sufficient to obtain a quantitative measurement of affinity, e.g., determined using a method such as ELISA or FACS analysis, is proportional to Ka, and thus can be used for comparisons, such as determining whether a higher affinity is, e.g., 2-fold higher, to obtain a qualitative measurement of affinity, or to obtain an inference of affinity, e.g., by activity in a functional assay, e.g., an in vitro or in vivo assay.

An "isolated composition" refers to a composition that is removed from at least 90% of at least one component of a natural sample from which the isolated composition can be obtained. Compositions produced artificially or naturally can be "compositions of at least" a certain degree of purity if the species or population of species of interests is at least 5, 10, 25, 50, 75, 80, 90, 92, 95, 98, or 99% pure on a weight-weight basis.

An "epitope" refers to the site on a target compound that is bound by a binding protein (e.g., an antibody such as a Fab or full length antibody). In the case where the target compound is a protein, the site can be entirely composed of amino acid components, entirely composed of chemical modifications of amino acids of the protein (e.g., glycosyl moieties), or composed of combinations thereof. Overlapping epitopes include at least one common amino acid residue.

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frameshift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences.

In a preferred embodiment, the length of a reference sequence aligned for comparison purposes is at least 30%, preferably at least 40%, more preferably at least 50%, even more preferably at least 60%, and even more preferably at least 70%, 80%, 90%, 92%, 95%, 97%, 98%, or 100% of the length of the reference sequence. For example, the reference sequence may be the length of the immunoglobulin variable domain sequence.

As used herein, the term "substantially identical" (or "substantially homologous") is used herein to refer to a first amino acid or nucleic acid sequence that contains a sufficient number of identical or equivalent (e.g., with a similar side chain, e.g., conserved amino acid substitutions) amino acid residues or nucleotides to a second amino acid or nucleic acid sequence such that the first and second amino acid or nucleic acid sequences have (or encode proteins having) similar activities, e.g., a binding activity, a binding preference, or a biological activity. In the case of antibodies, the second antibody has the same specificity and has at least 50% of the affinity relative to the same antigen.

Sequences similar or homologous (e.g., at least about 85% sequence identity) to the sequences disclosed herein are also part of this application. In some embodiment, the sequence identity can be about 85%, 90%, 91%, 92%, 93%, 94%, 95%, 96%, 97%, 98%, 99% or higher. In addition, substantial identity exists when the nucleic acid segments hybridize under selective hybridization conditions (e.g., highly stringent hybridization conditions), to the complement of the strand. The nucleic acids may be present in whole cells, in a cell lysate, or in a partially purified or substantially pure form.

As used herein, the term "hybridizes under low stringency, medium stringency, high stringency, or very high stringency conditions" describes conditions for hybridization and washing. Guidance for performing hybridization reactions can be found in *Current Protocols in Molecular Biology,* John Wiley & Sons, N.Y. (1989), 6.3.1-6.3.6, which is incorporated by reference. Aqueous and nonaqueous methods are described in that reference and either can be used. Specific hybridization conditions referred to herein are as follows: (1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); (2) medium stringency hybridization conditions in 6×SSC at about 45° C., followed by one or more washes in 0.2×SSC, 0.1% SDS at 60° C.; (3) high stringency hybridization conditions in 6×SSC at about 45° C., followed by one or more washes in 0.2×SSC, 0.1% SDS at 65° C.; and (4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions and the ones that should be used unless otherwise specified. The invention includes nucleic acids that hybridize with low, medium, high, or very high stringency to a nucleic acid described herein or to a complement thereof, e.g., nucleic acids encoding a binding protein described herein. The nucleic acids can be the same length or within 30, 20, or 10% of the length of the reference nucleic acid. The nucleic acid can correspond to a region encoding an immunoglobulin variable domain sequence.

An hK1 binding protein may have mutations relative to a binding protein described herein (e.g., a conservative or non-essential amino acid substitutions), which do not have a substantial effect on the protein functions. Whether or not a particular substitution will be tolerated, e.g., will not adversely affect biological properties, such as binding activity can be predicted, e.g., using the method of Bowie, et al. (1990) Science 247:1306-1310.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). It is possible for many framework and CDR amino acid residues to include one or more conservative substitutions.

Consensus sequences for biopolymers can include positions which can be varied among various amino acids. For example, the symbol "X" in such a context generally refers to any amino acid (e.g., any of the twenty natural amino acids or any of the nineteen non-cysteine amino acids). Other allowed amino acids can also be indicated for example, using parentheses and slashes. For example, "(A/W/F/N/Q)" means that alanine, tryptophan, phenylalanine, asparagine, and glutamine are allowed at that particular position.

A "non-essential" amino acid residue is a residue that can be altered from the wild-type sequence of the binding agent, e.g., the antibody, without abolishing or more preferably, without substantially altering a biological activity, whereas an "essential" amino acid residue results in such a change.

The terms "polypeptide" or "peptide" (which may be used interchangeably) refer to a polymer of three or more amino acids linked by a peptide bond, e.g., between 3 and 60, or 30 and 300, or over 300 amino acids in length. The polypeptide may include one or more unnatural amino acids. Typically, the polypeptide includes only natural amino acids. A "protein" can include one or more polypeptide chains. Accordingly, the term "protein" encompasses polypeptides. A protein or polypeptide can also include one or more modifications, e.g., a glycosylation, amidation, phosphorylation, and so forth.

The term "cognate substrate" refers to a naturally occurring substrate of hK1, including naturally occurring variants thereof (e.g., splice variants, naturally occurring mutants, and isoforms).

As used herein, the term "common codon" refers to the most common codon representing a particular amino acid in sequences of the species of cell that is used to express the protein. "Less-common codons" are codons that occurs frequently in the particular species but are not the common codon. All codons other than common codons and less-common codons are "non-common codons".

An "hK1-associated inflammatory disorder" refers to a disorder characterized by an inflammatory response mediated at least in part by hK1, e.g., the protease activity of hK1. For such disorders, a reduction in hK1 activity results in a reduced inflammatory response. Exemplary hK1-associated inflammatory disorders include asthma (e.g., allergic and non-allergic asthma), chronic obstructive pulmonary disease (COPD), multiple sclerosis, psoriasis, rheumatoid arthritis, osteopathic arthritis, osteoarthritis, rhinitis, sinusitis, inflammatory bowel diseases (such as Crohn's disease and ulcerative colitis), immune mediated diabetes, acute pancreatitis, and interstitial cystitis.

Statistical significance can be determined by any art known method. Exemplary statistical tests include: the Students T-test, Mann Whitney U non-parametric test, and Wilcoxon non-parametric statistical test. Some statistically significant relationships have a P value of less than 0.05 or 0.02. Particular binding proteins may show a difference, e.g., in specificity, binding, or biological activity, that are statistically significant (e.g., P value<0.05 or 0.02). The terms "induce", "inhibit", "potentiate", "elevate", "increase", "decrease" or the like, e.g., which denote distinguishable qualitative or quantitative differences between two states, and may refer to a difference, e.g., a statistically significant difference, between the two states.

Unless otherwise defined, all technical and scientific terms used herein have the same meaning as commonly understood by one of ordinary skill in the art to which this invention belongs. Although methods and materials similar or equivalent to those described herein can be used in the practice or testing of the invention, suitable methods and materials are described below. All publications, patent applications, patents, and other references mentioned herein are incorporated by reference in their entirety.

DETAILED DESCRIPTION hK1

Figure 1:
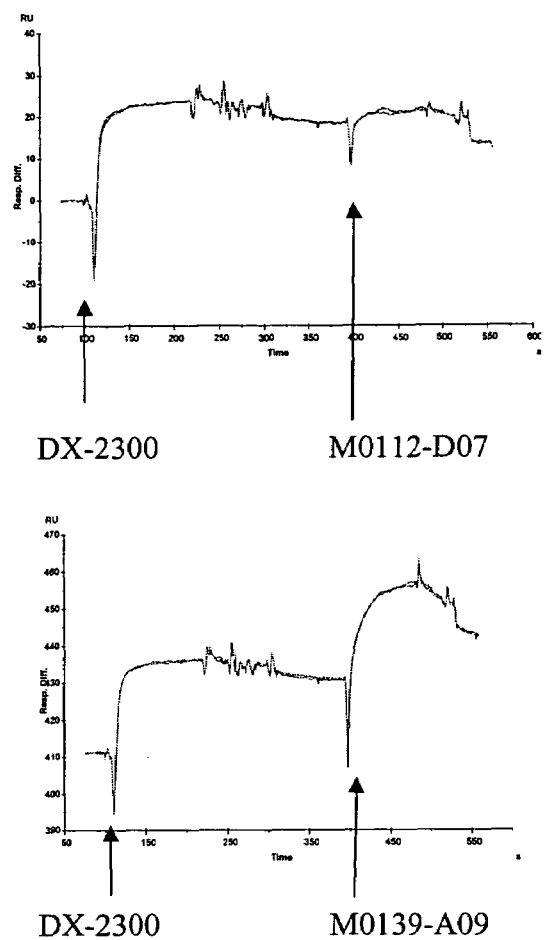
FIG. 1. Epitope grouping by SPR. Biotinylated hK1 was captured on a streptavidin coated chip to a final ligand density of 88 RU. DX-2300 was injected over immobilized hK1 at a concentration of 50 nM followed by an injection of a second Fab at a concentration of 50 nM at a flow rate of 30 µL/min at 25° C. in PBST using a Biacore 3000 instrument. The signal at the end of the injection of DX-2300 followed by a second Fab is R1. The signal at the end of the injection of the Fab alone is R2. Panel A shows the sensorgram for a Fab (M0112-D07) that binds the same epitope as DX-2300. Panel B shows the sensorgram for a Fab (M0139-A09) that bind a different epitope as DX-2300.

An exemplary hK1 protein includes the following sequence:

```
>sp|P06870|KLK1_HUMAN Kallikrein 1 precursor (EC
3.4.21.35) (Tissue kallikrein)
(Kidney/pancreas/salivary gland kallikrein) - Homo
sapiens (Human).
MWFLVLCLALSLGGTGAAPPIQSRIVGGWECEQHSQPWQAALYHFSTFQCG

GILVHRQWVLTAAHCISDNYQLWLGRHNLFDDENTAQFVHVSESFPHPGFN

MSLLENHTRQADEDYSHDLMLLRLTEPADTITDAVKVVELPTQEPEVGSTC

LASGWGSIEPENFSFPDDLQCVDLKILPNDECEKAHVQKVTDFMLCVGHLE

GGKDTCVGDSGGPLMCDGVLQGVTSWGYVPCGTPNKPSVAVRVLSYVKWIE

DTIAENS (SEQ ID NO:1021)
```

Typically the protein is a mature processed protein, e.g., a protein that includes about amino acids 25 to 262, or a fragment thereof, e.g., a proteolytically active fragment thereof.

An hK1 protein can includes one or more of the following features.

| | | | |
|---|---|---|---|
| SIGNAL | 1 | 18 | 18 Probable. |
| PROPEP | 19 | 24 | 6 Activation peptide (Probable). |
| CHAIN | 25 | 262 | 238 Kallikrein 1. |
| ACT_SITE | 65 | 65 | Charge relay system. |
| ACT_SITE | 120 | 120 | Charge relay system. |
| ACT_SITE | 214 | 214 | Charge relay system. |
| CARBOHYD | 93 | 93 | O-linked. |
| CARBOHYD | 102 | 102 | N-linked (GlcNAc . . . ). |
| CARBOHYD | 104 | 104 | O-linked. |
| CARBOHYD | 108 | 108 | N-linked (GlcNAc . . . ). |
| CARBOHYD | 165 | 165 | N-linked (GlcNAc . . . ); partial. |
| CARBOHYD | 167 | 167 | O-linked. |
| DISULFID | 31 | 174 | By similarity. |
| DISULFID | 50 | 66 | By similarity. |
| DISULFID | 153 | 220 | By similarity. |
| DISULFID | 185 | 199 | By similarity. |
| DISULFID | 210 | 235 | By similarity. |

An hK1 protein can also includes the following exemplary variants:

| | |
|---|---|
| VARIANT 77 | R → H |
| | (in dbSNP:5515) [NCBI/Ensembl]. VAR_014567 |
| VARIANT 145 | Q → E |
| | (in dbSNP:5516) [NCBI/Ensembl]. VAR_006625 |
| VARIANT 186 | E → K |
| | (in dbSNP:5517) [NCBI/Ensembl]. VAR_006626 |
| VARIANT 193 | V → E |
| | (in dbSNP:5518) [NCBI/Ensembl]. VAR_014568 |

Exemplary substrates for hK1 include pro-insulin, low density lipoprotein, the precursor of atrial natriuretic factor, prorenin, vasoactive intestinal peptide, procollagenase, and angiotensinogen. A hK1 binding protein described herein can be used to modulate such substrates, e.g., to reduce proteolytic cleavage of such substrates.

Antibodies that bind to hK1 can be obtained by using hK1 as an antigen, e.g., for immunizing an animal, or as a target, e.g., for screening a library of recombinant antibodies. Peptides and fragments of hK1 can also be used.

Display Libraries

In one embodiment, a display library is used to identify proteins that bind to hK1. A display library is a collection of entities; each entity includes an accessible protein component (e.g., a Fab or scFv) and a recoverable component (e.g., a nucleic acid) that encodes or identifies the protein component. The protein component can be of any length, e.g. from three amino acids to over 300 amino acids. In a selection, the protein component of each member of the library is contacted to hK1 and if the protein component binds to hK1, the display library member is identified, e.g., by retention on a support. The protein component can include one or more immunoglobulin variable domains or variants of another domain. Methods using immunoglobulin domains for display are described below (see, e.g., "Antibody Display Libraries").

Retained display library members are recovered from the support and analyzed. The analysis can include amplification and a subsequent selection under similar or dissimilar conditions. For example, positive and negative selections can be alternated. The analysis can also include determining the amino acid sequence of the protein component and purification of the protein component for detailed characterization.

A variety of formats can be used for display libraries. Examples include the following.

Phage Display. One format utilizes viruses, particularly bacteriophages. This format is termed "phage display." The protein component is typically covalently linked to a bacteriophage coat protein. The linkage results form translation of a nucleic acid encoding the protein component fused to the coat protein. The linkage can include a flexible peptide linker, a protease site, or an amino acid incorporated as a result of suppression of a stop codon. Phage display is described, for example, in U.S. Pat. No. 5,223,409; Smith (1985) *Science* 228:1315-1317; WO 92/18619; WO 91/17271; WO 92/20791; WO 92/15679; WO 93/01288; WO 92/01047; WO 92/09690; WO 90/02809; de Haard et al. (1999) *J. Biol. Chem* 274:18218-30; Hoogenboom et al. (1998) *Immunotechnology* 4:1-20; Hoogenboom et al. (2000) *Immunol Today* 2:371-8; Fuchs et al. (1991) *Bio/Technology* 9:1370-1372; Hay et al. (1992) *Hum Antibod Hybridomas* 3:81-85; Huse et al. (1989) *Science* 246:1275-1281; Griffiths et al. (1993) *EMBO J* 12:725-734; Hawkins et al. (1992) *J Mol Biol* 226:889-896; Clackson et al. (1991) *Nature* 352:624-628; Gram et al. (1992) *PNAS* 89:3576-3580; Garrard et al. (1991) *Bio/Technology* 9:1373-1377; Rebar et al. (1996) *Methods Enzymol.* 267:129-49; Hoogenboom et al. (1991) *Nuc Acid Res* 19:4133-4137; and Barbas et al. (1991) *PNAS* 88:7978-7982.

Phage display systems have been developed for filamentous phage (phage f1, fd, and M13) as well as other bacteriophage (e.g. T7 bacteriophage and lambdoid phages; see, e.g., Santini (1998) J. Mol. Biol. 282:125-135; Rosenberg et al. (1996) *Innovations* 6:1-6; Houshmet al. (1999) *Anal Biochem* 268:363-370). The filamentous phage display systems typically use fusions to a minor coat protein, such as gene III protein, and gene VIII protein, a major coat protein, but fusions to other coat proteins such as gene VI protein, gene VII protein, gene IX protein, or domains thereof can also been used (see, e.g., WO 00/71694). In one embodiment, the fusion is to a domain of the gene III protein, e.g., the anchor domain or "stump," (see, e.g., U.S. Pat. No. 5,658,727 for a description of the gene III protein anchor domain). It is also possible to physically associate the protein being displayed to the coat using a non-peptide linkage, e.g., a non-covalent bond or a non-peptide covalent bond. For example, a disulfide bond and/or c-fos and c-jun coiled-coils can be used for physical associations (see, e.g., Crameri et al. (1993) *Gene* 137:69 and WO 01/05950).

Bacteriophage displaying the protein component can be grown and harvested using standard phage preparatory methods, e.g. PEG precipitation from growth media. After selection of individual display phages, the nucleic acid encoding the selected protein components can be isolated from cells infected with the selected phages or from the phage themselves, after amplification. Individual colonies or plaques can be picked, the nucleic acid isolated and sequenced.

Other Display Formats. Other display formats include cell based display (see, e.g., WO 03/029456), protein-nucleic acid fusions (see, e.g., U.S. Pat. No. 6,207,446), and ribosome display (See, e.g., Mattheakis et al. (1994) *Proc. Natl. Acad. Sci. USA* 91:9022 and Hanes et al. (2000) *Nat Biotechnol.* 18:1287-92; Hanes et al. (2000) *Methods Enzymol.* 328:404-30; and Schaffitzel et al. (1999) *J Immunol Methods.* 231(1-2):119-35).

Epitope Specific Binding proteins. Display technology can also be used to obtain binding proteins, e.g., antibodies, that bind to particular epitopes of a target. Epitopes can be classified as "conformational" or "sequential". Conformational epitopes involve amino-acid residues that have a defined relative orientation in a properly folded target even though the amino acids may be substantially separated in the sequence (e.g., separated by at least one, two, four, six, eight or ten amino acids). Sequential epitopes involve short portions of the polypeptide chain that bind an antibody whatever the folding state of the protein (e.g., native or unfolded). Binding proteins for conformational epitopes can be identified, for example, by using competing non-target molecules that lack the particular epitope or are mutated within the epitope, e.g., with alanine. Such non-target molecules can be used in a negative selection procedure as described below, as competing molecules when binding a display library to the target, or as a pre-elution agent, e.g., to capture in a wash solution dissociating display library members that are not specific to the target. In another implementation, epitope specific binding proteins are identified by eluting display library members with a competing binding protein that binds to the epitope of interest on the target molecule. Binding proteins that bind sequential epitopes can be selected, for example, using short peptides that have amino-acid sequences found in a target protein. Often binding proteins that bind to conformational epitopes also bind weakly to one or another peptide that contains some of the amino acids involved in the conformational epitope. Thus, one can select for binding to a peptide at very low stringency and then select for binding to the folded target protein.

Affinity Maturation. In one embodiment, a binding protein that binds to a target is modified, e.g., by mutagenesis, to provide a pool of modified binding proteins. The modified binding proteins are then evaluated to identify one or more altered binding proteins which have altered functional properties (e.g., improved binding, improved stability, lengthened stability in vivo). In one implementation, display library technology is used to select or screen the pool of modified binding proteins. Higher affinity binding proteins are then identified from the second library, e.g., by using higher stringency or more competitive binding and washing conditions. Other screening techniques can also be used.

In some implementations, the mutagenesis is targeted to regions known or likely to be at the binding interface. If, for example, the identified binding proteins are antibodies, then mutagenesis can be directed to the CDR regions of the heavy or light chains as described herein. Further, mutagenesis can be directed to framework regions near or adjacent to the CDRs, e.g., framework regions, particular within ten, five, or three amino acids of a CDR junction. In the case of antibodies, mutagenesis can also be limited to one or a few of the CDRs, e.g., to make step-wise improvements.

In one embodiment, mutagenesis is used to make an antibody more similar to one or more germline sequences. One exemplary germlining method can include: identifying one or more germline sequences that are similar (e.g., most similar in a paticular database) to the sequence of the isolated antibody. Then mutations (at the amino acid level) can be made in the isolated antibody, either incrementally, in combination, or both. For example, a nucleic acid library that includes sequences encoding some or all possible germline mutations is made. The mutated antibodies are then evaluated, e.g., to identify an antibody that has one or more additional germline residues relative to the isolated antibody and that is still useful (e.g., has a functional activity). In one embodiment, as many germline residues are introduced into an isolated antibody as possible.

In one embodiment, mutagenesis is used to substitute or insert one or more germline residues into a CDR region. For example, the germline CDR residue can be from a germline sequence that is similar (e.g., most similar) to the variable region being modified. After mutagenesis, activity (e.g., binding or other functional activity) of the antibody can be evaluated to determine if the germline residue or residues are tolerated. Similar mutagenesis can be performed in the framework regions.

Selecting a germline sequence can be performed in different ways. For example, a germline sequence can be selected if it meets a predetermined criteria for selectivity or similarity, e.g., at least a certain percentage identity, e.g., at least 75, 80, 85, 90, 91, 92, 93, 94, 95, 96, 97, 98, 99, or 99.5% identity. The selection can be performed using at least 2, 3, 5, or 10 germline sequences. In the case of CDR1 and CDR2, identifying a similar germline sequence can include selecting one such sequence. In the case of CDR3, identifying a similar germline sequence can include selecting one such sequence, but may including using two germline sequences that separately contribute to the amino-terminal portion and the carboxy-terminal portion. In other implementations more than one or two germline sequences are used, e.g., to form a consensus sequence.

In one embodiment, with respect to a particular reference variable domain sequence, e.g., a sequence described herein, a related variable domain sequence has at least 30, 40, 50, 60, 70, 80, 90, 95 or 100% of the CDR amino acid positions that are not identical to residues in the reference CDR sequences, residues that are identical to residues at corresponding positions in a human germline sequence (i.e., an amino acid sequence encoded by a human germline nucleic acid).

In one embodiment, with respect to a particular reference variable domain sequence, e.g., a sequence described herein, a related variable domain sequence has at at least 30, 50, 60, 70, 80, 90 or 100% of the FR regions are identical to FR sequence from a human germline sequence, e.g., a germline sequence related to the reference variable domain sequence.

Accordingly, it is possible to isolate an antibody which has similar activity to a given antibody of interest, but is more similar to one or more germline sequences, particularly one or more human germline sequences. For example, an antibody can be at least 90, 91, 92, 93, 94, 95, 96, 97, 98, 99, 99.5% identical to a germline sequence in a region outside the CDRs (e.g., framework regions). Further an antibody can include at least 1, 2, 3, 4, or 5 germline residues in a CDR region, the germline residue being from a germline sequence of similar (e.g., most similar) to the variable region being modified. Germline sequences of primary interest are human germline sequences. The activity of the antibody (e.g., the binding activity) can be within a factor or 100, 10, 5, 2, 0.5, 0.1, and 0.001 of the original antibody. An exemplary germline sequences include VKI-O2, VL2-1, VKIII-L2::JK2, vg3-23, V3-23::JH4, and V3-23::JK6.

Some exemplary mutagenesis techniques include: error-prone PCR (Leung et al. (1989) *Technique* 1:11-15), recombination (see, e.g., U.S. Ser. No. 10/279,633), DNA shuffling using random cleavage (Stemmer (1994) *Nature* 389-391; termed "nucleic acid shuffling"), RACHITT™ (Coco et al. (2001) *Nature Biotech.* 19:354), site-directed mutagenesis (Zoller et al. (1987) *Nucl Acids Res* 10:6487-6504), cassette mutagenesis (Reidhaar-Olson (1991) *Methods Enzymol.* 208:564-586) and incorporation of degenerate oligonucleotides (Griffiths et al. (1994) *EMBO J* 13:3245).

In one example of affinity maturation the methods described herein are used to first identify a binding protein from a display library that binds an hK1 with at least a minimal binding specificity for a target or a minimal activity, e.g., an equilibrium dissociation constant for binding of less than 1 nM, 10 nM, or 100 nM. The nucleic acid sequence encoding the initial identified binding protein are used as a template nucleic acid for the introduction of variations, e.g., to identify a second binding protein that has enhanced properties (e.g., binding affinity, kinetics, or stability) relative to the initial binding protein. Alternatively, the amino-acid sequence of one or more CDRs can be used as a guide for design of a nucleic acid library that includes nucleic acids encoding the isolated sequence and many neighboring sequences. Such diversified nucleic acids can be introduced into a display vector containing the initial isolate and improved variants are selected from the library.

Off-Rate Selection. Since a slow dissociation rate can be predictive of high affinity, particularly with respect to interactions between polypeptides and their targets, the methods described herein can be used to isolate binding proteins with a desired kinetic dissociation rate (i.e. reduced) for a binding interaction to a target.

To select for slow dissociating binding proteins from a display library, the library is contacted to an immobilized target. The immobilized target is then washed with a first solution that removes non-specifically or weakly bound biomolecules. Then the immobilized target is eluted with a second solution that includes a saturation amount of free target, e.g., replicates of the target that are not attached to the particle. The free target binds to biomolecules that dissociate from the target. Rebinding is effectively prevented by the saturating amount of free target relative to the much lower concentration of immobilized target.

The second solution can have solution conditions that are substantially physiological or that are stringent. Typically, the solution conditions of the second solution are identical to the solution conditions of the first solution. Fractions of the second solution are collected in temporal order to distinguish early from late fractions. Later fractions include biomolecules that dissociate at a slower rate from the target than biomolecules in the early fractions.

Further, it is also possible to recover display library members that remain bound to the target even after extended incubation. These can either be dissociated using chaotropic conditions or can be amplified while attached to the target. For example, phage bound to the target can be contacted to bacterial cells.

Selecting and Screening for Specificity. "Selection", in the context of a display library, refers to a process in which many members of a display library are allowed to contact the target and those that bind are recovered and propagated. The selection can be from a library having numerous members, e.g., more than $10^{10}$ members. "Screening", in the context of a display library, refers to a process in which isolated members of the library are tested singly for binding to the target. Through automation, thousands of candidates may be screened in a highly parallel process. The display library selection methods described herein can include a selection process that discards display library members that bind to a non-target molecule.

Examples of non-target molecules, e.g., for an hK1 binding antibody, include, e.g., proteases other hK1, e.g., kallikreins other than hK1, e.g., hK2, hK3 hK4, hK5, hK6, hK7, hK8, hK9, hK10, hK11, hK12, hK13, hK14, or hK15. Useful hK1 binding antibodies may be specific for a subset of kallikreins, e.g., they may interact with a plurality of kallikreins, at least one of which is hK1.

In one implementation, a so-called "negative selection" step is used to discriminate between the target and related non-target molecule and a related, but distinct non-target molecule. The display library or a pool thereof is contacted to the non-target molecule. Members of the sample that do not bind the non-target are collected and used in subsequent selections for binding to the target molecule or even for subsequent negative selections. The negative selection step can be prior to or after selecting library members that bind to the target molecule.

In another implementation, a screening step is used. After display library members are isolated for binding to the target molecule, each isolated library member is tested for its ability to bind to a non-target molecule (e.g., a non-target listed above). For example, a high-throughput ELISA screen can be used to obtain this data. The ELISA screen can also be used to obtain quantitative data for binding of each library member to the target. The non-target and target binding data are compared (e.g., using a computer and software) to identify library members that specifically bind to hK1.

The display library selection and screening methods described herein can include a selection or screening process that selects for display library members that bind to specific sites on the target molecule. For example, elution with high concentration of an antibody described herein selects for phage that bind to the epitope bound by such an antibody. One can screen for a phage that binds to a particular epitope of hK1 by performing ELISAs with and without a competing antibody that recognizes the epitope in the buffer.

Antibody Display Libraries

In one embodiment, the display library presents a diverse pool of proteins, each of which includes at least one and typically two immunoglobulin variable domains. Display libraries are particular useful, for example, for identifying human or effectively human antibodies that recognize human antigens. Since the constant and framework regions of the antibody are human, these therapeutic antibodies may avoid themselves being recognized and targeted as antigens. The constant regions are also optimized to recruit effector functions of the human immune system. The in vitro display selection process surmounts the inability of a normal human immune system to generate antibodies against self-antigens.

A typical antibody display library displays a protein that includes a VH domain and a VL domain. The display library can display the antibody as a Fab fragment (e.g., using two polypeptide chains) or a single chain Fv (e.g., using a single polypeptide chain). Other formats can also be used.

As in the case of the Fab and other formats, the displayed antibody can include a constant region as part of a light or heavy chain. In one embodiment, each chain includes one constant region, e.g., as in the case of a Fab. In other embodiments, additional constant regions are displayed.

Antibody libraries can be constructed by a number of processes (see, e.g., de Haard et al. (1999) *J. Biol. Chem* 274:18218-30; Hoogenboom et al. (1998) *Immunotechnology* 4:1-20; Hoogenboom et al. (2000) *Immunol Today* 21:371-8; US 2003-0232333 and US 2004-0029113). Further, elements of each process can be combined with those of other processes. The processes can be used such that variation is introduced into a single immunoglobulin domain (e.g., VH or VL) or into multiple immunoglobulin domains (e.g., VH and VL). The variation can be introduced into an immunoglobulin variable domain, e.g., in the region of one or more of CDR1, CDR2, CDR3, FR1, FR2, FR3, and FR4, referring to such regions of either and both of heavy and light chain variable domains. In one embodiment, variation is introduced into all three CDRs of a given variable domain. In another preferred embodiment, the variation is introduced into CDR1 and CDR2, e.g., of a heavy chain variable domain. Any combination is feasible. In one process, antibody libraries are constructed by inserting diverse oligonucleotides that encode CDRs into the corresponding regions of the nucleic acid encoding the display protein or portion thereof. The oligonucleotides can be synthesized using a variety of subunits, e.g., monomeric nucleotides or trinucleotides. For example, Knappik et al. (2000) *J. Mol. Biol.* 296:57-86 describe a method for constructing CDR encoding oligonucleotides using trinucleotide synthesis and a template with engineered restriction sites for accepting the oligonucleotides.

In another process, an animal, e.g., a rodent, is immunized with the hK1. The animal is optionally boosted with the antigen to further stimulate the response. Then spleen cells are isolated from the animal, and nucleic acid encoding VH and/or VL domains is amplified and cloned for expression in the display library.

In yet another process, antibody libraries are constructed from nucleic acid amplified from naïve germline immunoglobulin genes (e.g., human genes). The amplified nucleic acid includes nucleic acid encoding the VH and/or VL domain. Sources of immunoglobulin-encoding nucleic acids are described below. Amplification can include PCR, e.g., with primers that anneal to the conserved constant region, or another amplification method.

Nucleic acid encoding immunoglobulin domains or fragments thereof can be obtained from the immune cells of, e.g., a human, a primate, mouse, rabbit, camel, or rodent. Cells can be selected for a particular property. For example, B cells at various stages of maturity, including naïve B cells, can be selected.

Fluorescent-activated cell sorting (FACS) can be used to sort B cells that express surface-bound IgM, IgD, or IgG molecules. Further, B cells expressing different isotypes of IgG can be isolated. B and T cells can be cultured and stimulated in vitro, e.g., by culturing with feeder cells or by adding mitogens or other modulatory reagents, such as antibodies to CD40, CD40 ligand or CD20, phorbol myristate acetate, bacterial lipopolysaccharide, concanavalin A, phytohemagglutinin or pokeweed mitogen.

Cells can also be isolated from a subject that has an immunological disorder, e.g., systemic lupus erythematosus (SLE), rheumatoid arthritis, vasculitis, Sjogren syndrome, systemic sclerosis, or anti-phospholipid syndrome. The subject can be a human, or an animal, e.g., an animal model for the human disease, or an animal having an analogous disorder. Cells can be isolated from a transgenic non-human animal that includes a human immunoglobulin locus.

The cells can have activated a program of somatic hypermutation. Cells can be stimulated to undergo somatic mutagenesis of immunoglobulin genes, for example, by treatment with anti-immunoglobulin, anti-CD40, and anti-CD38 antibodies (see, e.g., Bergthorsdottir et al. (2001) J Immunol. 166:2228). In another embodiment, the cells are naïve.

The nucleic acid encoding an immunoglobulin variable domain can be isolated from a natural repertoire by the following exemplary method. First, RNA is isolated from the immune cell. Full length (e.g., capped) mRNAs are separated (e.g. by dephosphorylating uncapped RNAs with calf intestinal phosphatase). The cap is then removed with tobacco acid pyrophosphatase and reverse transcription is used to produce the cDNAs.

The reverse transcription of the first (antisense) strand can be done in any manner with any suitable primer. See, e.g., de Haard et al. (1999) *J. Biol. Chem* 274:18218-30. The primer binding region can be constant among different immunoglobulins, e.g., in order to reverse transcribe different isotypes of immunoglobulin. The primer binding region can also be specific to a particular isotype of immunoglobulin. Typically, the primer is specific for a region that is 3' to a sequence encoding at least one CDR. In another embodiment, poly-dT primers may be used (and may be preferred for the heavy-chain genes).

A synthetic sequence can be ligated to the 3' end of the reverse transcribed strand. The synthetic sequence can be used as a primer binding site for binding of the forward primer during PCR amplification after reverse transcription. The use of the synthetic sequence can obviate the need to use a pool of different forward primers to fully capture the available diversity.

The variable domain-encoding gene is then amplified, e.g., using one or more rounds. If multiple rounds are used, nested primers can be used for increased fidelity. The amplified nucleic acid is then cloned into a display library vector.

Antibody Production

Some antibodies, e.g., Fabs, can be produced in bacterial cells, e.g., *E. coli* cells. For example, if the Fab is encoded by sequences in a phage display vector that includes a suppressible stop codon between the display entity and a bacteriophage protein (or fragment thereof), the vector nucleic acid can be shuffled into a bacterial cell that cannot suppress a stop codon. In this case, the Fab is not fused to the gene III protein and is secreted into the media.

Antibodies can also be produced in eukaryotic cells. In one embodiment, the antibodies (e.g., scFv's) are expressed in a yeast cell such as *Pichia* (see, e.g., Powers et al. (2001) *J Immunol Methods.* 251:123-35), *Hanseula,* or *Saccharomyces.*

In one embodiment, antibodies, particularly full length antibodies, e.g., IgG's, are produced in mammalian cells. Exemplary mammalian host cells for recombinant expression include Chinese Hamster Ovary (CHO cells) (including dhfr– CHO cells, described in Urlaub and Chasin (1980) *Proc. Natl. Acad. Sci. USA* 77:4216-4220, used with a DHFR selectable marker, e.g., as described in Kaufman and Sharp (1982) *Mol. Biol.* 159:601-621), lymphocytic cell lines, e.g., NS0 myeloma cells and SP2 cells, COS cells, K562, and a cell from a transgenic animal, e.g., a transgenic mammal. For example, the cell is a mammary epithelial cell.

In addition to the nucleic acid sequence encoding the immunoglobulin domain, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399, 216, 4,634,665 and 5,179,017). Exemplary selectable marker genes include the dihydrofolate reductase (DHFR) gene (for use in dhfr⁻ host cells with methotrexate selection/ amplification) and the neo gene (for G418 selection).

In an exemplary system for recombinant expression of an antibody (e.g., a full length antibody or an antigen-binding portion thereof), a recombinant expression vector encoding both the antibody heavy chain and the antibody light chain is introduced into dhfr–CHO cells by calcium phosphate-mediated transfection. Within the recombinant expression vector, the antibody heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells, and recover the antibody from the culture medium. For example, some antibodies can be isolated by affinity chromatography with a Protein A or Protein G.

For antibodies that include an Fc domain, the antibody production system may synthesize antibodies in which the Fc region is glycosylated. For example, the Fc domain of IgG molecules is glycosylated at asparagine 297 in the CH2 domain. This asparagine is the site for modification with biantennary-type oligosaccharides. This glycosylation participates in effector functions mediated by Fcγ receptors and complement C1q (Burton and Woof (1992) *Adv. Immunol.* 51:1-84; Jefferis et al. (1998) *Immunol. Rev.* 163:59-76). The Fc domain can be produced in a mammalian expression system that appropriately glycosylates the residue corresponding to asparagine 297. The Fc domain can also include other eukaryotic post-translational modifications.

Antibodies may also include modifications, e.g., that alter Fc function. For example, the human IgG1 constant region can be mutated at one or more residues, e.g., one or more of residues 234 and 237, e.g., according to the number in U.S. Pat. No. 5,648,260. Other exemplary modifications include those described in U.S. Pat. No. 5,648,260.

Antibodies can also be produced by a transgenic animal. For example, U.S. Pat. No. 5,849,992 describes a method for expressing an antibody in the mammary gland of a transgenic mammal. A transgene is constructed that includes a milk-specific promoter and nucleic acids encoding the antibody of interest and a signal sequence for secretion. The milk produced by females of such transgenic mammals includes, secreted-therein, the antibody of interest. The antibody can be purified from the milk, or for some applications, used directly.

It is also possible to produce antibodies that bind to hK1 by immunization, e.g., using an animal, e.g., with natural, human, or partially human immunoglobulin loci. In one embodiment, the non-human animal includes at least a part of a human immunoglobulin gene. For example, it is possible to engineer mouse strains deficient in mouse antibody production with large fragments of the human Ig loci. Using the hybridoma technology, antigen-specific monoclonal antibodies derived from the genes with the desired specificity may be produced and selected. See, e.g., XenoMouse™, Green et al. Nature Genetics 7:13-21 (1994), U.S. 2003-0070185, and WO 96/34096.

All or part of hK1 can be used as an immunogen.

Non-human antibodies can also be modified to include substitutions that insert human immunoglobulin sequences, e.g., consensus human amino acid residues at particular positions, e.g., at one or more of the following positions (preferably at least five, ten, twelve, or all): (in the FR of the variable domain of the light chain) 4L, 35L, 36L, 38L, 43L, 44L, 58L, 46L, 62L, 63L, 64L, 65L, 66L, 67L, 68L, 69L, 70L, 71L, 73L, 85L, 87L, 98L, and/or (in the FR of the variable domain of the heavy chain) 2H, 4H, 24H, 36H, 37H, 39H, 43H, 45H, 49H, 58H, 60H, 67H, 68H, 69H, 70H, 73H, 74H, 75H, 78H, 91H, 92H, 93H, and/or 103H (according to the Kabat numbering). See, e.g., U.S. Pat. No. 6,407,213.

Exemplary Human Antibodies

In one embodiment, an hK1 binding antibody described herein includes one or more human framework sequences, e.g., a human or effectively human FR1, FR2, FR3, and/or FR4 in the heavy and/or light chain variable domain sequence.

In one implementation the heavy chain variable domain sequence has H1 and H2 hypervariable loops have the 1-3 canonical structures according to Chothia et al. (1992) *J. Mol. Biol.* 227:799-817; Tomlinson et al. (1992) *J. Mol. Biol.* 227:776-798). Exemplary frameworks which are compatible with these structures include the following sequences for FR1 (SEQ ID NOs 42, 43, 44, 78, 84, 86, 90, 96, 103, 104 and 105), FR2 (SEQ ID NOs 108, 109, 110, 109, 109, 109, 108, 108, 108, 108 and 109) and FR3 (SEQ ID NOs 114, 122, 114, 127, 114, 139, 139, 140, 139, 140 and 144) respectively:

| | |
|---|---|
| EVQLVESGGGLVQPGGSLRLSCAASGFTF | (SEQ ID NO:42) |
| WVRQAPGKGLEWVA | (SEQ ID NO:108) |
| RFTISRDNAKNSLYLQMNSLRAEDTAVYYCAR | (SEQ ID NO:114) |
| EVQLVESGGGLVQPGRSLRLSCAASGFTF | (SEQ ID NO:43) |
| WVRQAPGKGLEWVS | (SEQ ID NO:109) |
| RFTISRDNAKNSLYLQMNSLRAEDTALYYCAKD | (SEQ ID NO:122) |
| QVQLVESGGGLVKPGGSLRLSCAASGFTF | (SEQ ID NO:44) |
| WIRQAPGKGLEWVS | (SEQ ID NO:110) |
| RFTISRDNAKNSLYLQMNSLRAEDTAVYYCAR | (SEQ ID NO:114) |
| EVQLVESGGGVVRPGGSLRLSCAASGFTF | (SEQ ID NO:78) |
| WVRQAPGKGLEWVS | (SEQ ID NO:109) |
| RFTISRDNAKNSLYLQMNSLRAEDTALYHCAR | (SEQ ID NO:127) |
| EVQLVESGGGLVKPGGSLRLSCAASGFTF | (SEQ ID NO:80) |
| WVRQAPGKGLEWVS | (SEQ ID NO:109) |
| RFTISRDNAKNSLYLQMNSLRAEDTAVYYCAR | (SEQ ID NO:114) |
| EVQLLESGGGLVQPGGSLRLSCAASGFTF | (SEQ ID NO:86) |
| WVRQAPGKGLEWVS | (SEQ ID NO:109) |
| RFTISRDNSKNTLYLQMNSLRAEDTAVYYCAK | (SEQ ID NO:139) |
| QVQLVESGGGVVQPGRSLRLSCAASGFTF | (SEQ ID NO:90) |
| WVRQAPGKGLEWVA | (SEQ ID NO:108) |
| RFTISRDNSKNTLYLQMNSLRAEDTAVYYCAK | (SEQ ID NO:139) |
| QVQLVESGGGVVQPGRSLRLSCAASGFTF | (SEQ ID NO:96) |
| WVRQAPGKGLEWVA | (SEQ ID NO:108) |
| RFTISRDNSKNTLYLQMNSLRAEDTAVYYCAR | (SEQ ID NO:140) |

```
                                        -continued
QVQLVESGGGVVQPGRSLRLSCAASGFTF               (SEQ ID NO:103)

WVRQAPGKGLEWVA                              (SEQ ID NO:108)

RFTISRDNSKNTLYLQMNSLRAEDTAVYYCAK            (SEQ ID NO:139)

QVQLVESGGGVVQPGRSLRLSCAASGFTF               (SEQ ID NO:104)

WVRQAPGKGLEWVA                              (SEQ ID NO:108)

RFTISRDNSKNTLYLQMNSLRAEDTAVYYCAR            (SEQ ID NO:140)

EVQLVESGGVVVQPGGSLRLSCAASGFTF               (SEQ ID NO:105)

WVRQAPGKGLEWVS                              (SEQ ID NO:109)

RFTISRDNSKNSLYLQMNSLRTEDTALYYCAKD           (SEQ ID NO:144)
```

Generally, frameworks from any human germline antibody sequences that are compatible with a 1-3 canonical structure can be used for the heavy chain. Similarly, light chain frameworks can be selected from compatible human germline antibody sequences for respectively light chain CDRs. Frameworks from VH or VL segments can be used for FR1, FR2, and FR3.

Target Protein Production hK1 can be produced by recombinant expression techniques, e.g., expression in *E. coli* or *Pichia pastoris*. Human kallikrein hK1 can also be purified to homogeneity from urine essentially as described in Irie et al. (1986) Biochem. Int. 13, 375-382.

Binding Assays

ELISA. Proteins, e.g., antibodies that may interact with hK1, can be evaluated for an interaction property, e.g., a binding property using an ELISA assay. For example, each protein is contacted to a microtitre plate whose bottom surface has been coated with the target, e.g., a limiting amount of the target. The plate is washed with buffer to remove non-specifically bound polypeptides. Then the amount of the protein bound to the plate is determined by probing the plate with an antibody that can recognize the polypeptide, e.g., a tag or constant portion of the polypeptide. The antibody is linked to an enzyme such as alkaline phosphatase, which produces a colorimetric product when appropriate substrates are provided. The protein can be purified from cells or assayed in a display library format, e.g., as a fusion to a filamentous bacteriophage coat. Alternatively, cells (e.g., live or fixed) that express the target molecule, e.g., hK1, can be plated in a microtitre plate and used to test the affinity of the peptides/antibodies present in the display library or obtained by selection from the display library.

In another version of the ELISA assay, each polypeptide of a diversity strand library is used to coat a different well of a microtitre plate. The ELISA then proceeds using a constant target molecule to query each well.

Homogeneous Binding Assays. The binding interaction of candidate protein with a target can be analyzed using a homogenous assay, e.g., after all components of the assay are added, additional fluid manipulations are not required. For example, fluorescence resonance energy transfer (FRET) can be used as a homogenous assay (see, for example, Lakowicz et al., U.S. Pat. No. 5,631,169; Stavrianopoulos, et al., U.S. Pat. No. 4,868,103). A fluorophore label on the first molecule (e.g., the molecule identified in the fraction) is selected such that its emitted fluorescent energy can be absorbed by a fluorescent label on a second molecule (e.g., the target) if the second molecule is in proximity to the first molecule. The fluorescent label on the second molecule fluoresces when it absorbs to the transferred energy. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. A binding event that is configured for monitoring by FRET can be conveniently measured through standard fluorometric detection means well known in the art (e.g., using a fluorimeter). By titrating the amount of the first or second binding molecule, a binding curve can be generated to estimate the equilibrium binding constant.

Another example of a homogenous assay is Alpha Screen (Packard Bioscience, Meriden Conn.). Alpha Screen uses two labeled beads. One bead generates singlet oxygen when excited by a laser. The other bead generates a light signal when singlet oxygen diffuses from the first bead and collides with it. The signal is only generated when the two beads are in proximity. One bead can be attached to the display library member, the other to the target. Signals are measured to determine the extent of binding, The homogenous assays can be performed while the candidate protein is attached to the display library vehicle, e.g., a bacteriophage or using a candidate protein as free molecule.

Surface Plasmon Resonance (SPR). The binding interaction of a molecule isolated from a display library and a target can be analyzed using SPR. SPR or Biomolecular Interaction Analysis (BIA) detects biospecific interactions in real time, without labeling any of the interactants. Changes in the mass at the binding surface (indicative of a binding event) of the BIA chip result in alterations of the refractive index of light near the surface (the optical phenomenon of surface plasmon resonance (SPR)). The changes in the refractivity generate a detectable signal, which are measured as an indication of real-time reactions between biological molecules. Methods for using SPR are described, for example, in U.S. Pat. No. 5,641,640; Raether (1988) *Surface Plasmons* Springer Verlag; Sjolander and Urbaniczky (1991) *Anal. Chem.* 63:2338-2345; Szabo et al. (1995) *Curr. Opin. Struct. Biol.* 5:699-705 and on-line resources provide by BIAcore International AB (Uppsala, Sweden).

Information from SPR can be used to provide an accurate and quantitative measure of the equilibrium dissociation constant ($K_d$), and kinetic parameters, including $K_{on}$ and $K_{off}$, for the binding of a biomolecule to a target. Such data can be used to compare different biomolecules. For example, proteins encoded by nucleic acid selected from a library of diversity strands can be compared to identify individuals that have high affinity for the target or that have a slow $K_{off}$. This information can also be used to develop structure-activity relationships (SAR). For example, the kinetic and equilibrium binding parameters of matured versions of a parent protein can be compared to the parameters of the parent protein. Variant amino acids at given positions can be identified that correlate with particular binding parameters, e.g., high affinity and slow $K_{off}$. This information can be combined with structural modeling (e.g., using homology modeling, energy minimization, or structure determination by crystallography or NMR). As a result, an understanding of the physical interaction between the protein and its target can be formulated and used to guide other design processes.

Protein Arrays. Polypeptides identified from the display library can be immobilized on a solid support, for example, on a bead or an array. For a protein array, each of the polypeptides is immobilized at a unique address on a support. Typically, the address is a two-dimensional address. Protein arrays are described below (see, e.g., Diagnostics).

Biological Assays

In vitro biochemical assays can be used to evaluate inhibition of hK1 proteolysis. See, e.g., Bourgeois et al. (1997) *J. Biol. Chemistry* 272:29590-29595. Exemplary peptide substrates that can be used to monitor hK1 proteolysis include: Abz-FRSARQ-EDDnp, Abz-TFRSARQ-EDDnp, Abz-FFFRSARQ-EDDnp, Abz-AIKFFSAQ-EDDnp, Abz-VIAGRSLNPNQ-EDDnp, Abz-AMSRMSLSSFSVNRQ-EDDnp, Abz-AIKFFSRQ-EDDnp, and Abz-TFFSARQ-EDDnp, wherein Abz represents o-aminobenzoyl, and EDDnp represents N-(2,4-dinitrophenyl)ethylenediamine. The intramolecularly quenched fluorogenic peptides can be synthesized by classical solution methods; a glutamine can be positioned as the C-terminal residue. See, e.g., Hirata et al. Lett. Pept. Sci. 1, 299-308. Syntheses can be performed with Fmoc methodology using a multiple automated peptide synthesizer (PSSM-8, Shimadzu Co.). Intramolecularly quenched fluorogenic substrates can be prepared as 2 mM stock solutions in N,N-dimethylformamide and diluted with activation buffer. Substrate purity can be checked by MALDI-TOF mass spectrometry (TofSpec-E, Micromass) and by reverse-phase chromatography on a C18 column eluted with a 10-min linear gradient of 0-60% acetonitrile in 0.075% TFA at 2.0 m/min.

Exemplary conditions for evaluating enzymatic kinetics are at 37° C. in 50 mM Tris-HCl buffer, pH 8.3, containing 1 mM EDTA and 0.02% IGEPAL (previously Nonidet P-40).

Animal Models

U.S. Pat. No. 5,911,988 describes an exemplary mouse model for asthma. The mouse model can be used to evaluate the ability of an hK1 binding protein that also recognizes the murine KLK1 protein. The mouse may also be modified to express hK1. The mouse is subjected to long-term repeated inhalations of allergen and can be used to evaluate the long term effect of allergic diseases in the lung, and to delineate the cells, mechanisms, molecules, and mediators involved in the induction of airway hyperresponsiveness of lung in humans.

Female BALB/c mice (6-8 wk) can be used and maintained under conventional conditions for the studies.

Reagents: Crystalline OVA was obtained from Pierce Chem. Co. (Rockford, Ill.) aluminum potassium sulfate (alum) from Sigma Chem. Co. (St. Louis, Mo.), pyrogen-free distilled water from Baxter, Healthcare Corporation (Deerfield, Ill.), 0.9% sodium chloride (normal saline) from Lymphomed (Deerfield, Ill.) and TRAPPSOL™ HPB-L100 (aqueous hydroxypropyl beta cyclodextrin; 45 wt/vol % aqueous solution) from Cyclodextrin Technologies Development, Inc. (Gainesville, Fla.).

Allergen Immunization/Challenge Protocols: Mice received an i.p. injection of 0.2 ml (100 μg) of OVA with alum (J. Exp Med. 1996; 184: 1483-1494). Different protocols may be used. For example, mice can be anesthetized with 0.2 ml i.p. of ketamine (0.44 mg/ml)/xylazine (6.3 mg/ml) in normal saline before receiving an intranasal (i.n.) dose of 100 μg OVA in 0.05 ml normal saline and an i.n. dose of 50 μg OVA in 0.05 ml normal saline separately on different days. To evaluate an hK1 binding protein, the protein can be administered with a test dosage of the hK1 binding protein, e.g., before the intranasal dose challenge, and compared to corresponding control mice that receive a control administration that does not include the hK1 binding protein.

Histology. The trachea and left lung (the right lung is used for bronchoalveolar lavage ("BAL")) are obtained and fixed in 10% neutral formaldehyde solution at room temperature for 6.about.15 h. After being embedded in paraffin, the tissues are cut into 5 μm sections and can be processed with the different staining or immunolabling further. Discombe's eosinophil staining can be used for counting the cell numbers with the counterstain of methylene blue. The eosinophil number per unit airway area (2,200 μm$^2$) can be determined by morphometry (J. Pathol. 1992; 166: 395404; Am Rev Respir Dis. 1993; 147:448-456). Fibrosis can be identified with the Masson's trichrome staining. Airway mucus can be identified by the following staining method: methylene blue, hematoxylin and eosin, mucicarmine, alcian blue, and alcian blue/periodic acid-Schiff (PAS) reaction (Troyer, H., "Carbohydrates" in Principles and Techniques of Histochemistry, Little, Brown and Company, Boston, Mass., 1980: 89-121; Sheehan, D. C., et al., "Carbohydrates" in Theory and Practice of Histotechnology, Battle Press, Columbus, Ohio, 1980: 159-179). Mucin can be stained with mucicarmine solution; metanil yellow counterstain was employed. Acidic mucin and sulfated mucosubstances can be stained with alcian blue, pH 2.5; nuclear fast red counterstain can also used. Neutral and acidic mucosubstances were identified by alcian blue, pH 2.5, and PAS reaction. The degree of mucus plugging of the airways (0.5-0.8 mm in diameter) can also assessed by morphometry. The percent occlusion of airway diameter by mucus was classified on a semiquantitative scale from 0 to 4+. The histologic and morphometric analyses can be performed by individuals blinded to the protocol design.

Pulmonary Function Testing. On day 28, 24 hours after the last i.n. administration of either normal saline or OVA, pulmonary mechanics to intravenous infusion of methacholine can be determined in mice in vivo by a plethysmographic method, e.g., as previously described (10, 1958; 192: 364-368; J. Appl. Physiol. 1988; 64: 2318-2323; J. Exp. Med. 1996; 184: 1483-1494), or using modifications thereof. At the completion of pulmonary function testing, each mouse can be exsanguinated by cardiac puncture and the lung tissue with trachea can be used for the further analysis.

Bronchoalveolar Lavage. After tying off the left lung at the mainstem bronchus, the right lung can be lavaged three times with 0.4 ml of normal saline. Bronchoalveolar lavage (BAL) fluid cells from a 0.05-ml aliquot of the pooled sample are counted using a hemocytometer and the remaining fluid centrifuged at 4° C. for 10 minutes at 200 g. The supernatant is stored at −70° C. until eicosanoid analysis is performed. After resuspension of the cell pellet in normal saline containing 10% bovine serum albumin ("BSA"), BAL cell smears can be made on glass slides. To stain eosinophils, dried slides are stained with Discombe's diluting fluid (0.05% aqueous eosin and 5% acetone (vol/vol) in distilled water; J. Exp. Med. 1970; 131: 1271-1287) for 5-8 minutes, rinsed with water for 0.5 minutes, and counterstained with 0.07% methylene blue for 2 minutes.

Assay of Airway Mucus Glycoproteins. Mucus glycoproteins in BAL fluid are assayed by slot blotting and PAS staining (Anal. Biochem. 1989; 182: 160-164; Am. J. Respir. Cell Mol. Biol. 1995; 12: 296-306). Nitrocellulose membranes (0.2-.mu.m pore size; Schleicher & Schuell, Keene, N.H.) are wetted in distilled water and then in normal saline before placement in a Minifold II 72-well slot blot apparatus (Schleicher & Schuell). The BAL fluid samples (0.05 ml)

and aliquots (0.05-0.75 1) of a stock solution (2.mu.m/ml) of human respiratory mucin glycoprotein (Am. J. Respir. Cell Mol. Biol. 1991; 5: 71-79) are blotted onto the nitrocellulose membranes by water suction vacuum, and mucus glycoproteins are visualized by PAS reaction. Reflectance densitometry can be performed to quantitate the PAS staining. TThe integrated intensity of the PAS reactivity of the BAL samples can be quantitated by comparison to the standard curve for human respiratory mucin.

Immunocytochemistry. Monoclonal antibody: CD11c (DAB method) and Mac1(Beringer Mannheim, ABC method with Hitomouse Kit, Zymed) can be used to identify inflammatory cell types, e.g., dendric cells, macrophages and lymphocytes, in/around the areas of vasculatures, airways and fibrosis.

U.S. Pat. No. 6,462,020 describes an exemplary mouse model for arthritis, the induced Type II Collagen Arthritis Mouse Model. The mouse model can be used to evaluate the effect of hK1 binding proteins on the histological, radiographic and clinical appearance of induced type II collagen arthritis.

Autoimmune diseases cause significant and chronic morbidity and disability. Arthritis in its many forms is representative of a family of autoimmune diseases. In the clinical realm, rheumatoid arthritis (RA) is the most common form of the severe arthrodysplastic disease. RA is a progressive disease.

The histopathology of arthritic lesions occurring in murine CIA share enormous similarities to that of RA in human patients. Murine CIA is a useful model to study potential therapeutic treatments of RA.

Materials and Methods Mice: DBA/1(2) male mice weighing 25 gms (Jackson Laboratories, Bar Harbor, Me. or B&K Universal, Kent Wash.) are used for this work. This strain of mouse is susceptible to CIA by the injection of heterologous type II collagen. Bovine Collagen (BC), Complete Freund's Adjuvant (CFA) and Incomplete Freund's Adjuvant (ICFA) can be obtained from Sigma Chemical. Antigen for immunization is processed in 0.1 M acetic acid and formulated with CFA or ICFA.

Induction of Arthritis. Immunization protocol: Mice are injected with 100 μg of type II collagen in CFA at predetermined intervals during the study period.

The mice are examined at predetermined intervals for the development of arthritis. Presumptive evidence of arthritis includes swelling and erythema of at least one toe joint on the front and/or rear feet on two consecutive observations.

Confirmatory Diagnosis of Arthritis. Histological Examination of joints: The toe joints of animals sacrificed at appropriate intervals are removed, fixed, decalcified, embedded, in paraffin, sectioned, and stained for observation of general cellular and structural features and to detect cartilaginous matrix of the pannus of each joint, as appropriate. The degree of cellularity and areas of inflammation are quantified by using digitization of histological photomicrographs and applying standard area and point counting techniques as described above.

Radiographic evaluation of toe joints is performed to detect the incidence of joint changes after immunization with type II collagen. A mammography imaging system has been modified for this work. The average area of soft tissue (pannus) of the joint is determined by analysis of computer digitized radiographs, along with changes in density of the adjacent hard tissues by comparison with internal standards included with each radiograph. To serve as a baseline control for the changing density of the hard tissues and areas of panni, additional mice are used over the same period and the density and area data compared. The significance of the differences in density and area for control and experimental mice is assessed using paired T-tests at each time point.

Arthritis Evaluation. Animals are observed daily for the onset of arthritis. An arthritis index is derived by grading the severity of involvement of each paw on a scale from 0 to 4. Scoring is based upon the degree of peri-articular erythema and edema, as well as deformity of the joints. Swelling of hind paws is also quantitated by measuring the thickness of the ankle from the medial to the lateral malledus with a constant tension caliper.

Tuohy et al. (J. Immunol. (1988) 141: 1126-1130), Sobel et al. (J. Immunol. (1984) 132: 2393-2401), and Traugott (Cell Immunol. (1989) 119: 114-129), describe experimental autoimmune encephalitis (EAE) mouse model for multiple sclerosis. This mouse model can be used to evaluate an hK1 binding protein for modulation of a symptom of multiple sclerosis.

Pharmaceutical Compositions

Also featured is a composition, e.g., a pharmaceutically acceptable composition, that includes an hK1 binding protein, e.g., an hK1 binding antibody, e.g., as described herein. As used herein, "pharmaceutical compositions" encompass compounds (e.g., labeled compounds) for diagnostic (e.g., in vivo imaging) use as well as compounds for therapeutic or prophylactic use.

As used herein, "pharmaceutically acceptable carrier" includes any and all solvents, dispersion media, coatings, antibacterial and antifungal agents, isotonic and absorption delaying agents, and the like that are physiologically compatible. In one embodiment, the carrier is other than water. Preferably, the carrier is suitable for intravenous, intramuscular, subcutaneous, parenteral, spinal or epidermal administration (e.g., by injection or infusion). Depending on the route of administration, the active compound may be coated in a material to protect the compound from the action of acids and other natural conditions that may inactivate the compound.

A "pharmaceutically acceptable salt" refers to a salt that retains the desired biological activity of the parent compound and does not impart any undesired toxicological effects (see e.g., Berge, S. M., et al. (1977) J. Pharm. Sci. 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

The compositions of this invention may be in a variety of forms. These include, for example, liquid, semi-solid and solid dosage forms, such as liquid solutions (e.g., injectable and infusible solutions), dispersions or suspensions, tablets, pills, powders, liposomes and suppositories. The preferred form depends on the intended mode of administration and therapeutic application. Typical preferred compositions are in the form of injectable or infusible solutions, such as compositions similar to those used for administration of humans with antibodies. The preferred mode of administration is parenteral (e.g., intravenous, subcutaneous, intraperitoneal, intramuscular). In a preferred embodiment, the compound is administered by intravenous infusion or injection. In another preferred embodiment, the compound is administered by intramuscular or subcutaneous injection.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Pharmaceutical compositions typically must be sterile and stable under the conditions of manufacture and storage. A pharmaceutical composition can also be tested to insure it meets regulatory and industry standards for administration. For example, endotoxin levels in the preparation can be tested using the Limulus amebocyte lysate assay (e.g., using the kit from Bio Whittaker lot # 7L3790, sensitivity 0.125 EU/mL) according to the USP 24/NF 19 methods. Sterility of pharmaceutical compositions can be determined using thioglycollate medium according to the USP 24/NF 19 methods. For example, the preparation is used to inoculate the thioglycollate medium and incubated at 35° C. for 14 or more days. The medium is inspected periodically to detect growth of a microorganism.

The composition can be formulated as a solution, microemulsion, dispersion, liposome, or other ordered structure suitable to high drug concentration. Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

Exemplary methods for formulating antibodies for delivery by inhalation are described below.

In one embodiment, an hK1 binding antibody is formulated for subcutaneous delivery, e.g., subcutaneous injection. Subcutaneous delivery can be used to treat any disorder described herein. In one implementation, the antibody is provided as a stable lyophilized protein formulation that includes a lyoprotectant (e.g., a sugar such as sucrose or trehalose). The lyophilized formulation can be reconstituted to generate a stable reconstituted formulation having a protein concentration which is significantly higher (e.g. from about 2-40 times higher, preferably 3-10 times higher and most preferably 3-6 times higher) than the protein concentration in the pre-lyophilized formulation. In particular, while the protein concentration in the pre-lyophilized formulation may be 5 mg/mL or less, the protein concentration in the reconstituted formulation can be 50 mg/mL or more. Accordingly, the formulation can include at least about 50 mg/ml of the hK1 binding protein. Such high protein concentrations in the reconstituted formulation can be useful for subcutaneous administration.

The reconstituted formulation can be isotonic. It can include a preservative (such as bacteriostatic water for injection, BWFI). The reconstituted formulation may be used for a multi-use formulation. Such a formulation is useful, for example, where the patient requires frequent subcutaneous administrations of the protein to treat a chronic medical condition. The ratio of lyoprotectant to protein may, for example, be about 100-1500 mole trehalose or sucrose: 1 mole antibody. A buffer can be used to stabilize the pH of the pre-lyophilized preparation, e.g. a pH in the range of 6-8. For example, the buffer can include one or more amino acid, e.g., histidine, or other agent that buffers within the range of 6-8 or has a pKa in such range. The formulation may further include a surfactant (e.g. a polysorbate).

The compounds described herein can be administered by a variety of methods known in the art. For many applications, the route/mode of administration is intravenous injection or infusion. For example, for therapeutic applications, the compound can be administered by intravenous infusion at a rate of less than 30, 20, 10, 5, or 1 mg/min to reach a dose of about 1 to 100 mg/m or 7 to 25 mg/m$^2$. The route and/or mode of administration will vary depending upon the desired results. In certain embodiments, the active compound may be prepared with a carrier that will protect the compound against rapid release, such as a controlled release formulation, including implants, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known. See, e.g., *Sustained and Controlled Release Drug Delivery Systems*, J. R. Robinson, ed., Marcel Dekker, Inc., New York, 1978. Pharmaceutical formulation is a well-established art, and is further described in Gennaro (ed.), Remington: The Science and Practice of Pharmacy, 20$^{th}$ ed., Lippincott, Williams & Wilkins (2000) (ISBN: 0683306472); Ansel et al., Pharmaceutical Dosage Forms and Drug Delivery Systems, 7$^{th}$ Ed., Lippincott Williams & Wilkins Publishers (1999) (ISBN: 0683305727); and Kibbe (ed.), Handbook of Pharmaceutical Excipients American Pharmaceutical Association, 3$^{rd}$ ed. (2000) (ISBN: 091733096X).

In certain embodiments, the composition may be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compound may be incorporated with excipients and used in the form of ingestible tablets, buccal tablets, troches, capsules, elixirs, suspensions, syrups, wafers, and the like. To administer a compound by other than parenteral administration, it may be necessary to coat the compound with, or co-administer the compound with, a material to prevent its inactivation.

Pharmaceutical compositions can be administered with medical devices known in the art. For example, in a preferred embodiment, a pharmaceutical composition of the invention can be administered with a needleless hypodermic injection device, such as the devices disclosed in U.S. Pat. Nos. 5,399,163, 5,383,851, 5,312,335, 5,064,413, 4,941, 880, 4,790,824, or 4,596,556. Examples of well-known implants and modules useful in the present invention include: U.S. Pat. No. 4,487,603, which discloses an implantable micro-infusion pump for dispensing medication at a controlled rate; U.S. Pat. No. 4,486,194, which discloses a therapeutic device for administering medicants through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multi-chamber compartments; and U.S. Pat. No. 4,475,196, which discloses an osmotic drug delivery system. Of course, many other such implants, delivery systems, and modules are also known.

In certain embodiments, the compound can be formulated to ensure proper distribution in vivo. For example, the blood-brain barrier (BBB) excludes many highly hydrophilic compounds. To ensure that the therapeutic compounds of the invention cross the BBB (if desired), they can be formulated, for example, in liposomes. For methods of manufacturing liposomes, see, e.g., U.S. Pat. Nos. 4,522,811; 5,374,548; and 5,399,331. The liposomes may comprise one or more moieties that are selectively transported into specific cells or organs, thus enhance targeted drug delivery (see, e.g., V. V. Ranade (1989) *J. Clin. Pharmacol.* 29:685).

Also within the scope of the invention are kits comprising a composition described herein (e.g., a composition a compound that contains an hK1 binding protein and instructions for use, e.g., treatment, prophylactic, or diagnostic use. In one embodiment, the kit includes (a) the compound, e.g., a composition that includes the compound, and, optionally, (b) informational material. The informational material can be descriptive, instructional, marketing or other material that relates to the methods described herein and/or the use of the compound for the methods described herein. For example, the informational material describes methods for administering the compound to reduce hK1 activity or to treat or prevent an hK1-associated disorder.

In one embodiment, the informational material can include instructions to administer the compound in a suitable manner, e.g., in a suitable dose, dosage form, or mode of administration (e.g., a dose, dosage form, or mode of administration described herein). In another embodiment, the informational material can include instructions for identifying a suitable subject, e.g., a human, e.g., a human having, or at risk for an hK1-associated disorder or a disorder characterized by excessive hK1 activity. The informational material can include information about production of the compound, molecular weight of the compound, concentration, date of expiration, batch or production site information, and so forth. The informational material of the kits is not limited in its form. In many cases, the informational material, e.g., instructions, is provided in printed matter, e.g., a printed text, drawing, and/or photograph, e.g., a label or printed sheet. However, the informational material can also be provided in other formats, such as Braille, computer readable material, video recording, or audio recording. In another embodiment, the informational material of the kit is a link or contact information, e.g., a physical address, email address, hyperlink, website, or telephone number, where a user of the kit can obtain substantive information about the compound and/or its use in the methods described herein. Of course, the informational material can also be provided in any combination of formats.

In addition to the compound, the composition of the kit can include other ingredients, such as a solvent or buffer, a stabilizer or a preservative, and/or a second agent for treating a condition or disorder described herein. Alternatively, the other ingredients can be included in the kit, but in different compositions or containers than the compound. In such embodiments, the kit can include instructions for admixing the compound and the other ingredients, or for using the compound together with the other ingredients.

The compound can be provided in any form, e.g., liquid, dried or lyophilized form. It is preferred that the compound be substantially pure and/or sterile. When the compound is provided in a liquid solution, the liquid solution preferably is an aqueous solution, with a sterile aqueous solution being preferred. When the compound is provided as a dried form, reconstitution generally is by the addition of a suitable solvent. The solvent, e.g., sterile water or buffer, can optionally be provided in the kit.

The kit can include one or more containers for the composition containing the compound. In some embodiments, the kit contains separate containers, dividers or compartments for the composition and informational material. For example, the composition can be contained in a bottle, vial, or syringe, and the informational material can be contained in a plastic sleeve or packet. In other embodiments, the separate elements of the kit are contained within a single, undivided container. For example, the composition is contained in a bottle, vial or syringe that has attached thereto the informational material in the form of a label. In some embodiments, the kit includes a plurality (e.g., a pack) of individual containers, each containing one or more unit dosage forms (e.g., a dosage form described herein) of the compound. For example, the kit includes a plurality of syringes, ampules, foil packets, or blister packs, each containing a single unit dose of the compound. The containers of the kits can be air tight, waterproof (e.g., impermeable to changes in moisture or evaporation), and/or light-tight.

In one embodiment wherein the compound contains an hK1 binding antibody, the instructions for diagnostic applications include the use of the compound to detect hK1, in vitro, e.g., in a sample, e.g., a biopsy or cells from a patient having a pulmonary disorder or other disorder described herein, or in vivo. In another embodiment, the instructions for therapeutic applications include suggested dosages and/or modes of administration in a patient with a pulmonary disorder or other disorder described herein, e.g., asthma (e.g., allergic and non-allergic asthma), chronic obstructive pulmonary disease (COPD), multiple sclerosis, psoriasis, rheumatoid arthritis, osteopathic arthritis, osteoarthritis, rhinitis, sinusitus, inflammatory bowel diseases (such as Crohn's disease and ulcerative colitis), immune mediated diabetes, acute pancreatitis, interstitial cystitis or a neoplastic disorder (e.g., a metastatic disorder or tumor angiogenesis). The kit can further contain a least one additional reagent, such as a diagnostic or therapeutic agent, e.g., a diagnostic or therapeutic agent as described herein, and/or one or more additional agents to treat the disorder, formulated as appropriate, in one or more separate pharmaceutical preparations.

Treatments

An hK1 binding protein can be administered to a subject, e.g., a human subject, to treat, prevent, and/or diagnose a variety of disorders, such as hK1-associated disorders and diseases characterized by unwanted or aberrant hK1 activity. Exemplary disorders include asthma (e.g., allergic and non-allergic asthma), chronic obstructive pulmonary disease (COPD), multiple sclerosis, psoriasis, rheumatoid arthritis, osteoarthritis, rhinitis, sinusitis, inflammatory bowel diseases such as Crohn's disease and ulcerative colitis, immune mediated diabetes, acute pancreatitis, interstitial cystitis, or other hK1-associated disorder, or a neoplastic disorder (e.g., metastatic pancreatic adenocarcinomas, tumor angiogenesis). An "hK1-associated disorder" is a disorder in which hK1 mediates at least in part, such that reducing hK1 protein levels or activity can ameliorate at least one aspect of the disorder, e.g., at least one symptom of the disorder.

In addition to being administered to a subject, the compound can also be administered to cells, tissues, or organs in culture, e.g. in vitro or ex vivo.

As used herein, the term "treat" or "treatment" is defined as the application or administration of a compound, alone or in combination with one or more other agents, to a subject, e.g., a patient, or application or administration of the agent to an isolated tissue or cell, e.g., cell line, from a subject, e.g., a patient, who has a disorder (e.g., a disorder as described herein), a symptom of a disorder or a predisposition toward a disorder, with the purpose to cure, heal, alleviate, relieve, alter, remedy, ameliorate, improve or affect the disorder, the symptoms of the disorder or the predisposition toward the disorder.

As used herein, an amount of an hK1 binding protein effective to treat a disorder, or a "therapeutically effective amount" refers to an amount of the compound which is effective, upon single or multiple dose administration to a subject, in treating a subject, e.g., curing, alleviating, relieving or ameliorating at least one symptom of a disorder in a subject to a degree beyond that expected in the absence of such treatment. For example, the disorder can be a pulmonary disorder, e.g., a pulmonary disorder described herein.

A "locally effective amount" refers to the amount (e.g., concentration) of the compound which is effective at detectably modulating activity of a target protein (e.g., hK1) in a tissue, e.g., in a region of the lung exposed to hK1. Evidence of modulation can include, e.g., increased amount of substrate, e.g., reduced proteolysis of the substrate.

As used herein, an amount of an hK1 binding protein effective to prevent a disorder, or a "a prophylactically effective amount" of the protein refers to an amount of an hK1-binding protein which is effective, upon single- or multiple-dose administration to the subject, in preventing or delaying the occurrence of the onset or recurrence of a disorder, e.g., an hK1 associated disorder.

The terms "induce", "inhibit", "potentiate", "elevate", "increase", "decrease" or the like, e.g., which denote quantitative differences between two states, refer to a difference, e.g., a statistically significant difference (e.g., P<0.05, 0.02, or 0.005), between the two states.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

An exemplary, non-limiting range for a therapeutically or prophylactically effective amount of a compound described herein is 0.1-20 mg/kg, more preferably 1-10 mg/kg. The compound can be administered by intravenous infusion at a rate of less than 20, 10, 5, or 1 mg/min to reach a dose of about 1 to 50 mg/m2 or about 5 to 20 mg/m$^2$. It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are only exemplary.

A pharmaceutical composition may include a "therapeutically effective amount" or a "prophylactically effective amount" of a compound described herein, e.g., a compound that includes a polypeptide that binds and inhibits hK1.

A therapeutically effective amount of the composition may vary according to factors such as the disease state, age, sex, and weight of the individual, and the ability of the compound to elicit a desired response in the individual. A therapeutically effective amount is also one in which any toxic or detrimental effects of the composition is outweighed by the therapeutically beneficial effects.

As used herein, the term "subject" is intended to include human and non-human animals. The term "non-human animals" of the invention includes all vertebrates, e.g., non-mammals (such as chickens, amphibians, reptiles) and mammals, such as non-human primates, sheep, dog, cow, pig, etc.

The subject method can be used on cells in culture, e.g. in vitro or ex vivo. The method can be performed on cells present in a subject, as part of an in vivo (e.g., therapeutic or prophylactic) protocol. For in vivo embodiments, the contacting step is effected in a subject and includes administering the hK1-binding protein to the subject under conditions effective to permit both binding of the protein to hK1.

Methods of administering compounds are described in "Pharmaceutical Compositions." Suitable dosages of the compounds used will depend on the age and weight of the subject and the particular drug used. The compounds can be used as competitive agents to inhibit, reduce an undesirable interaction, e.g., between a natural substrate and hK1.

hK1 binding proteins may also be used to deliver a variety of payloads, for example, drugs including therapeutic drugs, a compound emitting radiation, molecules of plants, fungal, or bacterial origin, biological proteins, and mixtures thereof. An hK1 binding protein can target the payload to a region of a subject in which hK1 is localized.

Enzymatically active toxins and fragments thereof are exemplified by diphtheria toxin A fragment, nonbinding active fragments of diphtheria toxin, exotoxin A (from *Pseudomonas aeruginosa*), ricin A chain, abrin A chain, modeccin A chain, α-sacrin, certain *Aleurites fordii* proteins, certain Dianthin proteins, *Phytolacca americana* proteins (PAP, PAPII and PAP-S), *Morodica charantia* inhibitor, curcin, crotin, *Saponaria officinalis* inhibitor, gelonin, mitogillin, restrictocin, phenomycin, and enomycin. Procedures for preparing enzymatically active polypeptides of the immunotoxins are described in WO 84/03508 and WO 85/03508. Examples of cytotoxic moieties that can be conjugated to the antibodies include adriamycin, chlorambucil, daunomycin, methotrexate, neocarzinostatin, and platinum.

In the case of polypeptide toxins, recombinant nucleic acid techniques can be used to construct a nucleic acid that encodes the hK1 binding protein and the cytotoxin (or a polypeptide component thereof) as translational fusions. The recombinant nucleic acid is then expressed, e.g., in cells and the encoded fusion polypeptide isolated. The fusion protein can be physically associated with a moiety that increases the molecular weight of the compound, e.g., to stabilize half-life in vivo, and then attached to a moiety (e.g., a polymer).

Procedures for conjugating proteins with the cytotoxic agents have been previously described. For conjugating chlorambucil with proteins, see, e.g., Flechner (1973) *European Journal of Cancer,* 9:741-745; Ghose et al. (1972) *British Medical Journal,* 3:495-499; and Szekerke, et al. (1972) *Neoplasma,* 19:211-215. For conjugating daunomycin and adriamycin to proteins, see, e.g., Hurwitz, E. et al. (1975) *Cancer Research,* 35:1175-1181 and Arnon et al. (1982) *Cancer Surveys,* 1:429-449. For preparing protein-ricin conjugates, see, e.g., U.S. Pat. No. 4,414,148 and by Osawa, T., et al. (1982) *Cancer Surveys,* 1:373-388 and the references cited therein. Coupling procedures as also described in EP 226 419.

In some embodiments, hK1 binding antibodies are used without conjugation to another moiety, e.g., as a full length antibody.

Chronic Obstructive Pulmonary Disease (COPD). The hK1 binding protein can also be used to ameliorate at least one symptom of a chronic obstructive pulmonary disease (COPD). Emphysema, along with chronic bronchitis, is part of chronic obstructive pulmonary disease (COPD). It is a serious lung disease and is progressive, usually occurring in elderly patients. COPD causes over-inflation of structures in the lungs known as alveoli or air sacs. The walls of the alveoli break down resulting in a decrease in the respiratory ability of the lungs. Patients with this disease may first experience shortness of breath and cough. One clinical index for evaluating COPD is the destructive index which measures a measure of alveolar septal damage and emphysema, and has been proposed as a sensitive index of lung destruction that closely reflects functional abnormalities, especially loss of elastic recoil. See, e.g., Am Rev Respir Dis 1991 July; 144(1):156-9. The compound can be used to reduce the destructive index in a patient, e.g., a statistically significant amount, e.g., at least 10, 20, 30, or 40% or at least to within 50, 40, 30, or 20% of normal of a corresponding age and gender-matched individual.

The composition can be formulated for inhalation or other mode of pulmonary delivery. Accordingly, the compounds described herein can be administered by inhalation to pulmonary tissue. The term "pulmonary tissue" as used herein refers to any tissue of the respiratory tract and includes both the upper and lower respiratory tract, except where otherwise indicated.

Accordingly, hK1 binding proteins can be administered in a method of treating (e.g., reducing, ameliorating) or preventing one or more symptoms associated with a respiratory disorder, e.g., asthma (e.g., allergic and nonallergic asthma); chronic obstructive pulmonary disease (COPD); a condition involving airway inflammation, eosinophilia, fibrosis and excess mucus production, e.g., cystic fibrosis and pulmonary fibrosis.

Asthma. Symptoms of asthma include, for example, wheezing, shortness of breath, bronchoconstriction, airway hyperreactivity, decreased lung capacity, fibrosis, airway inflammation, and mucus production). An hK1 binding protein can be used to ameliorate or prevent at least one symptom of asthma, e.g., one of the above. An hK1 binding protein can also be administered in conjunction with another agent for treating asthma, e.g., anti-IgE antibody, cromolyn sodium and nedocromil, an inhaled steroids, a leukotriene modifier, a long-acting beta-agonists, an oral steroid, and theophylline. Rheumatoid Arthritis (RA). This disorder is characterized by inflammation in the lining of the joints and/or other internal organs. It is typically chronic, but can include flare-ups. Exemplary symptoms include inflammation of joints, swelling, difficulty moving, pain, loss of appetite, fever, loss of energy, anemia, lumps (rheumatoid nodules) under the skin, especially in areas subject to pressure (e.g., back of elbows). An hK1 binding protein can be used to ameliorate or prevent at least one symptom of rheumatoid arthritis.

An hK1 binding protein can be administered in conjunction with another agent for treating rheumatoid arthritis, such as NSAIDs and aspirin, analgesics, and corticosteroids, help reduce joint pain, stiffness and swelling. Exemplary agents include disease-modifying antirheumatic drugs (DMARDs) such as methotrexate, leflunomide, D-Penicillamine, sulfasalazine, gold therapy, minocycline, azathioprine, hydroxychloroquine (and other antimalarials), cyclosporine, Prosorba therapy, and biologic agents.

Multiple Sclerosis (MS). Multiple sclerosis is a central nervous system disease that is characterized by inflammation and loss of myelin sheaths. Patients that have MS or clinically probable MS may be identified by criteria establishing a diagnosis of clinically definite MS as defined by the workshop on the diagnosis of MS (Poser et al., Ann. Neurol. 13:227, 1983). Briefly, an individual with clinically definite MS has had two attacks and clinical evidence of either two lesions or clinical evidence of one lesion and paraclinical evidence of another, separate lesion. Definite MS may also be diagnosed by evidence of two attacks and oligoclonal bands of IgG in cerebrospinal fluid or by combination of an attack, clinical evidence of two lesions and oligoclonal band of IgG in cerebrospinal fluid.

Patents having MS or clinically probably MS can be administered an hK1 binding protein, e.g., an hK1 binding antibody, to ameliorate at least one symptom of MS. The hK1 binding protein can also be provided in conjunction with another agent, e.g., IFNβ-1a and IFNβ-1 b; a protein that simulates myelin basic protein (e.g., a synthetic protein, e.g., glatiramer acetate, COPAXONE®); corticosteroids; or mitoxantrone.

Effective treatment of multiple sclerosis may be examined in several different ways. Satisfying any of the following criteria evidences effective treatment Three main criteria are used: EDSS (extended disability status scale), appearance of exacerbations or MRI (magnetic resonance imaging). The EDSS is a means to grade clinical impairment due to MS (Kurtzke, Neurology 33:1444, 1983). Eight functional systems are evaluated for the type and severity of neurologic impairment. Briefly, prior to treatment, patients are evaluated for impairment in the following systems: pyramidal, cerebella, brainstem, sensory, bowel and bladder, visual, cerebral, and other. Follow-ups are conducted at defined intervals. The scale ranges from 0 (normal) to 10 (death due to MS). A decrease of one full step defines an effective treatment in the context of the present invention (Kurtzke, Ann. Neurol. 36:573-79, 1994). Exacerbations are defined as the appearance of a new symptom that is attributable to MS and accompanied by an appropriate new neurologic abnormality (IFNB MS Study Group, supra). In addition, the exacerbation must last at least 24 hours and be preceded by stability or improvement for at least 30 days. Briefly, patients are given a standard neurological examination by clinicians. Exacerbations are either mild, moderate, or severe according to changes in a Neurological Rating Scale (Sipe et al., Neurology 34:1368, 1984). An annual exacerbation rate and proportion of exacerbation-free patients are determined. Therapy is deemed to be effective if there is a statistically significant difference in the rate or proportion of exacerbation-free patients between the treated group and the placebo group for either of these measurements. In addition, time to first exacerbation and exacerbation duration and severity may also be measured. A measure of effectiveness as therapy in this regard is a statistically significant difference in the time to first exacerbation or duration and severity in the treated group compared to control group. MRI can be used to measure active lesions using gadolinium-DTPA-enhanced imaging (McDonald et al. Ann. Neurol. 36:14, 1994) or the location and extent of lesions using $T_2$-weighted techniques.

Exemplary symptoms associated with multiple sclerosis include: optic neuritis, diplopia, nystagmus, ocular dysmetria, internuclear ophthalmoplegia, movement and sound phosphenes, afferent pupillary defect, paresis, monoparesis, paraparesis, hemiparesis, quadraparesis, plegia, paraplegia, hemiplegia, tetraplegia, quadraplegia, spasticity, dysarthria, muscle atrophy, spasms, cramps, hypotonia, clonus, myoclonus, myokymia, restless leg syndrome, footdrop, dysfunctional reflexes, paraesthesia, anaesthesia, neuralgia, neuropathic and neurogenic pain, l'hermitte's, proprioceptive dysfunction, trigeminal neuralgia, ataxia, intention tremor, dysmetria, vestibular ataxia, vertigo, speech ataxia, dystonia, dysdiadochokinesia, frequent micturition, bladder spasticity, flaccid bladder, detrusor-sphincter dyssynergia, erectile dysfunction, anorgasmy, frigidity, constipation, fecal urgency, fecal incontinence, depression, cognitive dysfunction, dementia, mood swings, emotional lability, euphoria, bipolar syndrome, anxiety, aphasia, dysphasia, fatigue, uhthoffs symptom, gastroesophageal reflux, and sleeping disorders.

Osteoarthritis. Osteoarthritis is a degenerative joint disease. It is characterized by the breakdown of cartilage in the joint, thus causing bones to rub against each other, causing pain and loss of movement. An hK1 binding protein can be used to ameliorate or prevent at least one symptom of osteoarthritis. An hK1 binding protein can be administered in conjunction with another agent for treating osteoarthritis, such as a corticosteroid or a NSAID.

Angiogenesis-Associated and Neoplastic Disorders

In one embodiment, hK1 binding proteins can be administered to a subject to modulate angiogenesis or other processes associated with neoplasia and tumor growth. hK1 binding proteins, particularly ones that inhibit hK1 enzymatic activity, may be used to block tumor angiogenesis and/or cancer cell invasion and metastasis. hK1 inhibitor antibodies are potent and selective inhibitors, and thus are ideal agents for tumor therapy.

For example, an hK1 binding protein can be used to reduce angiogenesis (e.g., uncontrolled or unwanted angiogenesis)—such as angiogenesis associated with vascular malformations and cardiovascular disorders (e.g., atherosclerosis, restenosis and arteriovenous malformations), chronic inflammatory diseases (e.g., diabetes mellitus, inflammatory bowel disease, psoriasis and rheumatoid arthritis), aberrant wound repairs (e.g., those that are observed following excimer laser eye surgery), circulatory disorders (e.g., Raynaud's phenomenon), crest syndromes (e.g., calcinosis, esophageal and dyomotiloty), dermatological disorders (e.g., Port-wine stains, arterial ulcers, systemic vasculitis and scleroderma), or ocular disorders (e.g., blindness caused by neovascular disease, neovascular glaucoma, corneal neovascularization, trachoma, diabetic retinopathy and myopic degeneration). See, e.g., Carmeliet and Jain, 2000, *Nature*, 407: 249-257.

In particular, an HK1 binding protein can be used to reduce angiogenesis associated with neoplasia, e.g., cancer and tumor growth, e.g., growth of a benign, malignant, or metastatic tumor.

Examples of cancerous disorders include, but are not limited to, solid tumors, soft tissue tumors, and metastatic lesions. Examples include sarcomas, adenocarcinomas, and carcinomas, of the various organ systems, such as those affecting lung, breast, lymphoid, gastrointestinal (e.g., colon), and genitourinary tract (e.g., renal, urothelial cells), pharynx, prostate, ovary as well as adenocarcinomas which include malignancies such as most colon cancers, rectal cancer, renal-cell carcinoma, liver cancer, non-small cell carcinoma of the lung, pharynx, cancer of the small intestine, cancer of the esophagus and others.

Exemplary solid tumors that can be treated include: fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma.

The hk1 binding protein can also be used to treat a carcinoma, e.g., a malignancy of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. Exemplary carcinomas include adenocarcinoma, carcinomas of tissue of the cervix, lung, prostate, breast, head and neck, colon and ovary.

The hk1 binding protein can also be used to treat sarcomas, e.g., malignant tumors of mesenchymal derivation.

The method can also be used to inhibit the proliferation of hyperplastic/neoplastic cells of hematopoietic origin, e.g., arising from myeloid, lymphoid or erythroid lineages, or precursor cells thereof. For instance, the method can be used totreat various myeloid disorders including acute promyeloid leukemia (APML), acute myelogenous leukemia (AML) and chronic myelogenous leukemia (CML) (reviewed in Vaickus, L., 1991, *Crit. Rev. in Oncol. Hemotol.* 11:267-297). Lymphoid malignancies which may be treated by the subject method include, but are not limited to acute lymphoblastic leukemia (ALL), which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to, non-Hodgkin's lymphoma and variants thereof, peripheral T-cell lymphomas, adult T-cell leukemia/lymphoma (ATL), cutaneous T-cell lymphoma (CTCL), large granular lymphocytic leukemia (LGF) and Hodgkin's disease.

An hK1 binding protein can be administered in combination with another agent for treating a neoplastic and/or metastatic disorder. Examples of such other agents include:

(i) other antiangiogenic agents (for example, linomide, inhibitors of integrin $\alpha_v\beta_3$ function, angiostatin, razoxane);

(ii) cytostatic agents such as antiestrogens (for example tamoxifen, toremifene, raloxifene, droloxifene, iodoxifene), progestogens (for example megestrol acetate), aromatase inhibitors (for example anastrozole, letrozole, borazole, exemestane), antihormones, antiprogestogens, antiandrogens (for example flutamide, nilutamide, bicalutamide, cyproterone acetate), LHRH agonists and antagonists (for example gosereline acetate, leuprolide), inhibitors of testosterone 5.alpha.-dihydroreductase (for example finasteride), farnesyltransferase inhibitors, anti-invasion agents (for example metalloproteinase inhibitors like marimastat and inhibitors of urokinase plasminogen activator receptor function) and inhibitors of growth factor function, (such growth factors include for example EGF, FGF, platelet derived growth factor and hepatocyte growth factor such inhibitors include growth factor antibodies, growth factor receptor antibodies such as AVASTIN® (bevacizumab) and ERBITUX® (cetuximab); tyrosine kinase inhibitors and serine/threonine kinase inhibitors); and (iii) antiproliferative/antineoplastic drugs and combinations thereof, as used in medical oncology, such as antimetabolites (for example antifolates like methotrexate, fluoropyrimidines like 5-fluorouracil, purine and adenosine analogues, cytosine arabinoside); Intercalating antitumour antibiotics (for example anthracyclines like doxorubicin, daunomycin, epirubicin and idarubicin, mitomycin-C, dactinomycin, mithramycin); platinum derivatives (for example cisplatin, carboplatin); alkylating agents (for example nitrogen mustard, melphalan, chlorambucil, busulphan, cyclophosphamide, ifosfamide nitrosoureas, thiotepa; antimitotic agents (for example vinca alkaloids like vincristine and taxoids like TAXOL® (paclitaxel), TAXOTERE® (docetaxel) and newer microbtubule agents such as epothilone analogs, discodermolide analogs, and eleutherobin analogs); topoisomerase inhibitors (for example epipodophyllotoxins like etoposide and teniposide, amsacrine, topotecan); cell cycle inhibitors (for example flavopyridols); biological response modifiers and proteasome inhibitors such as VELCADE® (bortezomib).

Exemplary Modulators of VEGF Class Growth Factors

A variety of agents can be used to modulate activity of VEGF class growth factors, e.g., to modulate VEGF activity (for example, by modulating activity the protein itself, its receptor, or other signalling components). Such agents can be administered in combination with a hK1 binding protein to modulate angiogenesis and treat a neoplastic and/or metastatic disorder.

Agents can be small molecule inhibitors (e.g., compounds that do not include a peptide bond and/or compounds that are smaller than 700 Daltons molecular weight). Other agents include compounds, e.g., small molecule compounds or proteins, that bind to VEGF, VEGF-C, or receptors thereof. Still other agents modulate expression or activity of VEGF, VEGF-C, or receptors thereof.

Exemplary agents include the following:

Bevacizumab (AVASTIN®) is an antibody that binds to VEGF. Bevacizumab has been approved for the treatment of certain cancers. US 2004-0133357 describes additional antibodies that can inhibit VEGF.

US2003-0120038 describes soluble VEGF-receptor fragments that can have inhibitory activity. 2004-0054143 describes a small peptide fragment of VEGF which has inhibitory activity.

A number of small molecule inhibitors of VEGF activity are known. 2004-0147449 describes VEGF-R inhibitors, including a class of compounds exemplified by 4-Chlorophenyl][4-(4-pyridylmethyl)-phthalazin-1-yl]ammonium hydrogen succinate.

SU5416 (semaxanib) is a small molecule inhibitor of the vascular endothelial growth factor (VEGF) receptor-2 and KIT receptor tyrosine kinases. See, e.g., Heymach et al. Clin Cancer Res. Sep. 1, 2004; 10(17):5732-40. SU11248 is another exemplary inhibitor. See, e.g., Mendel (2003) Clin Cancer Res. 9(1):327-37.

4-[4-(1-Amino-1-methylethyl)phenyl]-2-[4-(2-morpholin-4-yl-ethyl)phenylamino]pyrimidine-5-carbonitrile (JNJ-17029259) and related compounds in the structural class of 5-cyanopyrimidines are orally available, selective, nanomolar inhibitors of the vascular endothelial growth factor receptor-2 (VEGF-R2) and other tyrosine kinases involved in angiogenesis, such as platelet-derived growth factor receptor, fibroblast growth factor receptor, VEGF-R1, and VEGF-R3. At nanomolar levels, JNJ-17029259 can inhibit proliferation/migration, the formation of vascular sprouting in the rat aortic ring model of angiogenesis, and the development of new veins and arteries in the chorioallantoic membrane assay. See, e.g., Emanuel et al. (2004) Mol Pharmacol. 2004 September; 66(3):635-47.

Still another small molecule inhibitor is ZD6474, which inhibits VEGF-R2 tyrosine kinase activity, but with additional inhibitory effects on other growth factors. See, e.g., Sandstrom et al. British Journal of Cancer advance online publication, 10 Aug. 2004; doi:10.1038/sj.bjc.6602108 www.bjcancer.com PTK787/ZK 222584 is another small molecule inhibitor VEGF receptor tyrosine kinase activity. (see, e.g., Thomas et al. (2003) Semin Oncol. 2003 June; 30(3 Suppl 6):32-8.). Mohammadi et al. (1998) EMBO Journal Vol. 17, pp. 5896-5904, 1998 describe a molecule of the pyrido[2,3-d]pyrimidine class, designated PD 173074, that selectively inhibits the tyrosine kinase activities of the FGF and VEGF receptors. Administration of PD 173074 in mice can effectively block angiogenesis with no apparent toxicity.

US 2002-0165174 describes oligonucleotides that inhibit VEGF. Antisense oligonucleotide can be used to lower VEGF and VEGF-C levels. Such oligonucleotides can reduce cancer cell growth, e.g., mesothelioma cell growth. Antibodies to VEGF receptors (VEGFR-2) and VEGF-C (VEGFR-3) have also been observed to slowed cancer cell growth. US 2004-0138163 describes siRNAs that can inhibit VEGF. Inhibitors nucleic acids such as anti-sense oligonucleotides, siRNAs, and ribozymes can be used to modulate expression of VEGF, VEGF-C, or receptors thereof. See, e.g., Int J Cancer May 1, 2003; 104(5): 603-10.

Other methods include killing or inhibiting cells that produce VEGF. A diphtheria toxin-VEGF fusion protein (DT-VEGF), which is highly toxic to cells that express VEGF, was inhibit proliferation mesothelioma cells. See, e.g., Blood Sep. 15, 2001; 98(6): 1904-13.

Inhibitors of VEGF class molecules are also reviewed, e.g., in Verheul et al. (2003) Drugs Today (Barc). 2003; 39 Suppl C:81-93.

Inhalation

A composition that includes an hK1 binding antibody can be formulated for inhalation or other mode of pulmonary delivery. Accordingly, the compounds described herein can be administered by inhalation to pulmonary tissue. The term "pulmonary tissue" as used herein refers to any tissue of the respiratory tract and includes both the upper and lower respiratory tract, except where otherwise indicated. An hK1 binding antibody can be administered in combination with one or more of the existing modalities for treating pulmonary diseases.

In one example, the compound is formulated for a nebulizer. In one embodiment, the compound can be stored in a lyophilized form (e.g., at room temperature) and reconstituted in solution prior to inhalation.

It is also possible to formulate the compound for inhalation using a medical device, e.g., an inhaler. See, e.g., U.S. Pat. No. 6,102,035 (a powder inhaler) and U.S. Pat. No. 6,012,454 (a dry powder inhaler). The inhaler can include separate compartments for the active compound at a pH suitable for storage and another compartment for a neutralizing buffer and a mechanism for combining the compound with a neutralizing buffer immediately prior to atomization. In one embodiment, the inhaler is a metered dose inhaler.

The three common systems used to deliver drugs locally to the pulmonary air passages include dry powder inhalers (DPIs), metered dose inhalers (MDIs) and nebulizers. MDIs, the most popular method of inhalation administration, may be used to deliver medicaments in a solubilized form or as a dispersion. Typically MDIs comprise a Freon or other relatively high vapor pressure propellant that forces aerosolized medication into the respiratory tract upon activation of the device. Unlike MDIs, DPIs generally rely entirely on the inspiratory efforts of the patient to introduce a medicament in a dry powder form to the lungs. Nebulizers form a medicament aerosol to be inhaled by imparting energy to a liquid solution. Direct pulmonary delivery of drugs during liquid ventilation or pulmonary lavage using a fluorochemical medium has also been explored. These and other methods can be used to deliver an hK1 binding antibody. In one embodiment, the hK1 binding antibody is associated with a polymer, e.g., a polymer that stabilizes or increases half-life of the compound.

For example, for administration by inhalation, an hK1 binding antibody is delivered in the form of an aerosol spray from pressured container or dispenser which contains a suitable propellant or a nebulizer. The compound may be in the form of a dry particle or as a liquid. Particles that include the compound can be prepared, e.g., by spray drying, by drying an aqueous solution of the hK1 binding antibody with a charge neutralizing agent and then creating particles from the dried powder or by drying an aqueous solution in an organic modifier and then creating particles from the dried powder.

The compound may be conveniently delivered in the form of an aerosol spray presentation from pressurized packs or a nebulizer, with the use of a suitable propellant, e.g., dichlorodifluoromethane, trichlorofluoromethane, dichlorotetrafluoroethane, carbon dioxide or other suitable gas. In the case of a pressurized aerosol, the dosage unit may be determined by providing a valve to deliver a metered amount. Capsules and cartridges for use in an inhaler or insufflator may be formulated containing a powder mix of an hK1 binding antibody and a suitable powder base such as lactose or starch, if the particle is a formulated particle. In addition to the formulated or unformulated compound, other materials such as 100% DPPC or other surfactants can be mixed with the hK1 binding antibody to promote the delivery and dispersion of formulated or unformulated compound. Methods of preparing dry particles are described, for example, in PCT Publication WO 02/32406.

An hK1 binding antibody can be formulated for aerosol delivery, e.g., as dry aerosol particles, such that when administered it can be rapidly absorbed and can produce a rapid local or systemic therapeutic result. Administration can be tailored to provide detectable activity within 2 minutes, 5 minutes, 1 hour, or 3 hours of administration. In some embodiments, the peak activity can be achieved even more quickly, e.g., within one half hour or even within ten minutes. An hK1 binding antibody can be formulated for longer biological half-life (e.g., by association with a polymer such as PEG) can be used as an alternative to other modes of administration, e.g., such that the compound enters circulation from the lung and is distributed to other organs or to a particular target organ.

In one embodiment, the hK1 binding antibody is delivered in an amount such that at least 5% of the mass of the polypeptide is delivered to the lower respiratory tract or the deep lung. Deep lung has an extremely rich capillary network. The respiratory membrane separating capillary lumen from the alveolar air space is very thin (<6 Sun) and extremely permeable. In addition, the liquid layer lining the alveolar surface is rich in lung surfactants. In other embodiments, at least 2%, 3%, 5%, 10%, 20%, 30%, 40%, 50%, 60%, 70%, or 80% of the composition of an hK1 binding antibody is delivered to the lower respiratory tract or to the deep lung. Delivery to either or both of these tissues results in efficient absorption of the compound and high bioavailability. In one embodiment, the compound is provided in a metered dose using, e.g., an inhaler or nebulizer. For example, the compound is delivered in a dosage unit form of at least about 0.02, 0.1, 0.5, 1, 1.5, 2, 5, 10, 20, 40, or 50 mg/puff or more.

The percent bioavailability can be calculated as follows: the percent bioavailability=$(AUC_{non-invasive}/AUC_{i.v.\ or\ s.c.}) \times (dose_{i.v.\ or\ s.c.}/dose_{non-invasive}) \times 100$.

Although not necessary, delivery enhancers such as surfactants can be used to further enhance pulmonary delivery. A "surfactant" as used herein refers to a compound having a hydrophilic and lipophilic moiety, which promotes absorption of a drug by interacting with an interface between two immiscible phases. Surfactants are useful in the dry particles for several reasons, e.g., reduction of particle agglomeration, reduction of macrophage phagocytosis, etc. When coupled with lung surfactant, a more efficient absorption of the compound can be achieved because surfactants, such as DPPC, will greatly facilitate diffusion of the compound. Surfactants are well known in the art and include but are not limited to phosphoglycerides, e.g., phosphatidylcholines, L-alpha-phosphatidylcholine dipalmitoyl (DPPC) and diphosphatidyl glycerol (DPPG); hexadecanol; fatty acids; polyethylene glycol (PEG); polyoxyethylene-9-; auryl ether; palmitic acid; oleic acid; sorbitan trioleate (Span 85); glycocholate; surfactin; poloxomer; sorbitan fatty acid ester; sorbitan trioleate; tyloxapol; and phospholipids.

In one embodiment, the surfactants for use in the compositions, including the concentrates and diluted compositions, provided herein are high-HLB (hydrophilic-lipophilic balance) surfactants. Such high-HLB surfactants generally have an HLB greater than about 10. The HLB is a measure on an arbitrary scale of the polarity of a surfactant or mixture of surfactants. In one embodiment, the compositions provided herein contain from about 3% to about 85% by weight of a high-HLB surfactant In one embodiment, the high-HLB surfactant is an ethoxylated derivative of vitamin E such as tocopheryl polyethylene glycol 1000 succinate (TPGS). TPGS has an HLB between about 15 and 19. See, e.g., US 2004-0023935

Stabilization and Retention

In one embodiment, an hK1 binding antibody is physically associated with a moiety that improves its stabilization and/or retention in circulation, e.g., in blood, serum, lymph, bronchoalveolar lavage, or other tissues, e.g., by at least 1.5, 2, 5, 10, or 50 fold.

For example, an hK1 binding antibody can be associated with a polymer, e.g., a substantially non-antigenic polymers, such as polyalkylene oxides or polyethylene oxides. Suitable polymers will vary substantially by weight. Polymers having molecular number average weights ranging from about 200 to about 35,000 (or about 1,000 to about 15,000, and 2,000 to about 12,500) can be used.

For example, an hK1 binding antibody can be conjugated to a water soluble polymer, e.g., hydrophilic polyvinyl polymers, e.g. polyvinylalcohol and polyvinylpyrrolidone. A non-limiting list of such polymers include polyalkylene oxide homopolymers such as polyethylene glycol (PEG) or polypropylene glycols, polyoxyethylenated polyols, copolymers thereof and block copolymers thereof, provided that the water solubility of the block copolymers is maintained. Additional useful polymers include polyoxyalkylenes such as polyoxyethylene, polyoxypropylene, and block copolymers of polyoxyethylene and polyoxypropylene (Pluronics); polymethacrylates; carbomers; branched or unbranched polysaccharides which comprise the saccharide monomers D-mannose, D- and L-galactose, fucose, fructose, D-xylose, L-arabinose, D-glucuronic acid, sialic acid, D-galacturonic acid, D-mannuronic acid (e.g. polymannuronic acid, or alginic acid), D-glucosamine, D-galactosamine, D-glucose and neuramnic acid including homopolysaccharides and heteropolysaccharides such as lactose, amylopectin, starch, hydroxyethyl starch, amylose, dextrane sulfate, dextran, dextrins, glycogen, or the polysaccharide subunit of acid mucopolysaccharides, e.g. hyaluronic acid; polymers of sugar alcohols such as polysorbitol and polymannitol; heparin or heparon.

Other compounds can also be attached to the same polymer, e.g., a cytotoxin, a label, or another targeting agent, e.g., another hK1 binding antibody or an unrelated ligand. Mono-activated, alkoxy-terminated polyalkylene oxides (PAO's), e.g., monomethoxy-terminated polyethylene glycols (mPEG's); $C_{1-4}$ alkyl-terminated polymers; and bis-activated polyethylene oxides (glycols) can be used for crosslinking. See, e.g., U.S. Pat. No. 5,951,974

In one embodiment, the polymer prior to cross-linking to the ligand need not be, but preferably is, water soluble. Generally, after crosslinking, the product is water soluble, e.g., exhibits a water solubility of at least about 0.01 mg/ml, and more preferably at least about 0.1 mg/ml, and still more preferably at least about 1 mg/ml. In addition, the polymer should not be highly immunogenic in the conjugate form, nor should it possess viscosity that is incompatible with intravenous infusion, aerosolization, or injection if the conjugate is intended to be administered by such routes.

In one embodiment, the polymer contains only a single group which is reactive. This helps to avoid cross-linking of ligand molecules to one another. However, it is within the scope herein to maximize reaction conditions to reduce cross-linking between ligand molecules, or to purify the reaction products through gel filtration or ion exchange chromatography to recover substantially homogenous derivatives. In other embodiments, the polymer contains two or more reactive groups for the purpose of linking multiple ligands to the polymer backbone. Again, gel filtration or ion exchange chromatography can be used to recover the desired derivative in substantially homogeneous form.

The molecular weight of the polymer can range up to about 500,000 D, and preferably is at least about 20,000 D, or at least about 30,000 D, or at least about 40,000 D. The molecular weight chosen can depend upon the effective size of the conjugate to be achieved, the nature (e.g. structure, such as linear or branched) of the polymer, and the degree of derivatization.

A covalent bond can be used to attach an hK1 binding antibody to a polymer, for example, crosslinking to the N-terminal amino group of the ligand and epsilon amino groups found on lysine residues of the ligand, as well as other amino, imino, carboxyl, sulfhydryl, hydroxyl or other hydrophilic groups. The polymer may be covalently bonded directly to the hK1 binding antibody without the use of a multifunctional (ordinarily bifunctional) crosslinking agent. Covalent binding to amino groups is accomplished by known chemistries based upon cyanuric chloride, carbonyl diimidazole, aldehyde reactive groups (PEG alkoxide plus diethyl acetyl of bromoacetaldehyde; PEG plus DMSO and acetic anhydride, or PEG chloride plus the phenoxide of 4-hydroxybenzaldehyde, activated succinimidyl esters, activated dithiocarbonate PEG, 2,4,5-trichlorophenylcloroformate or P-nitrophenylcloroformate activated PEG.) Carboxyl groups can be derivatized by coupling PEG-amine using carbodiimide. Sulfhydryl groups can be derivatized by coupling to maleimido-substituted PEG (e.g. alkoxy-PEG amine plus sulfosuccinimidyl 4-(N-maleimidomethyl)cyclohexane-1-carboxylate) WO 97/10847 or PEG-maleimide commercially available from Shearwater Polymers, Inc., Huntsville, Ala.). Alternatively, free amino groups on the ligand (e.g. epsilon amino groups on lysine residues) can be thiolated with 2-imino-thiolane (Traut's reagent) and then coupled to maleimide-containing derivatives of PEG, e.g., as described in Pedley et al., Br. J. Cancer, 70: 1126-1130 (1994).

Functionalized PEG polymers that can be attached to an hK1 binding antibody are available, e.g., from Shearwater Polymers, Inc. (Huntsville, Ala.). Such commercially available PEG derivatives include, e.g., amino-PEG, PEG amino acid esters, PEG-hydrazide, PEG-thiol, PEG-succinate, carboxymethylated PEG, PEG-propionic acid, PEG amino acids, PEG succinimidyl succinate, PEG succinimidyl propionate, succinimidyl ester of carboxymethylated PEG, succinimidyl carbonate of PEG, succinimidyl esters of amino acid PEGs, PEG-oxycarbonylimidazole, PEG-nitrophenyl carbonate, PEG tresylate, PEG-glycidyl ether, PEG-aldehyde, PEG vinylsulfone, PEG-maleimide, PEG-orthopyridyl-disulfide, heterofunctional PEGs, PEG vinyl derivatives, PEG silanes, and PEG phospholides. The reaction conditions for coupling these PEG derivatives may vary depending on the hK1 binding antibody, the desired degree of PEGylation, and the PEG derivative utilized. Some factors involved in the choice of PEG derivatives include: the desired point of attachment (such as lysine or cysteine R-groups), hydrolytic stability and reactivity of the derivatives, stability, toxicity and antigenicity of the linkage, suitability for analysis, etc. Specific instructions for the use of any particular derivative are available from the manufacturer.

The conjugates of an hK1 binding antibody and a polymer can be separated from the unreacted starting materials, e.g., by gel filtration or ion exchange chromatography, e.g., HPLC. Heterologous species of the conjugates are purified from one another in the same fashion. Resolution of different species (e.g. containing one or two PEG residues) is also possible due to the difference in the ionic properties of the unreacted amino acids. See, e.g., WO 96/34015.

EXAMPLE

The following is one exemplary strategy for identifying hK1 binding proteins, particularly hK1 inhibitors.

1) KLK1 cDNA

KLK1 cDNA was subcloned into expression vectors for expression in mammalian cells, *E. coli*, and *P. pastoris*. The sequence of the subcloned material was confirmed by DNA sequencing.

2) Protein Expression in *P. pastoris*

*P. pastoris* were transformed with the above subcloned cDNA and clones were selected for expression of hK1 as assessed by protein gel electrophoresis and enzyme activity measurements. Optimized expression conditions were determined and protein was induced in a large *P. pastoris* culture volume (2 L).

3) Protein Purification hK1 was purified according to Chan et al (1998) *Protein Expr Purif*, 12(3): p. 361-70.

4) Phage Display Selection and Screening

Binders to recombinant hK1 have been selected from Fab phage display libraries.

Two strategies were employed to favor the selection of antibodies that bind at the active site of the hK1 enzyme (Figure). Active site binders compete with enzyme substrate for binding to hK1 and can inhibit hK1 proteolytic activity. Both phage display selection strategies employed the use of hK1 immobilized on beads. Beads were prepared by mixing 5 µg of biotinylated hK1 with 5 mg streptavidin coated paramagnetic beads (Dynal) in a total volume of 500 µL with phosphate buffer saline and 0.1% Tween 20 (PBST) and incubating the mixture over night at 4° C. The mixture was then washed 5 times with PBST, 1 µM free biotin was added, then washed again 5 times with PBST, and finally blocked for 1 hour with 2% nonfat dry milk in PBST. The immobilization procedure resulted in complete capture of the biotinylated hK1 and yielded immobilized hK1 that was enzymatically active.

In the first selection strategy, phage (titer=$1 \times 10^{13}$ pfu) were incubated for 5 minutes with 0.25 mL of immobilized hK1 beads in PBST and a total volume of 1 mL. Phage that bound immobilized hK1 were extracted using a magnetic device and nonspecific phage were eluted by 12 wash cycles with PBST on an automated plate washer (Selection 1). Phage were then eluted from the extracted beads by incubation of 25 µM aprotinin, an active site inhibitor of hK1, for 2 hours, in order to obtain phage eluted from the active site of hK1. The phage eluted by aprotinin and the phage that remained on the beads were amplified according to standard procedures and were each adjusted to a titer of $1 \times 10^{11}$ pfu and then separately used as input phage for the next and final round of selection of this strategy (Round II).

In Round II, the two phage populations (aka two "sets", one eluted with aprotinin, the other remaining bound after aprotinin elution) were separately added to 0.05 mL of immobilized hK1 beads, brought to a total volume of 1 mL with PBST and allowed to incubate for 5 minutes before 12 wash cycles were performed. The two "sets" from Round II were then subjected to elution with 25 µM aprotinin for 2 hours to yield a total of 4 phage populations (aka "pools") for screening by ELISA for binding to hK1 where Pool 1 was derived from the aprotinin elution of Round I and the aprotinin elution of Round II, Pool 2 was derived from the aprotinin elution of Round I and the phage that remained on the beads in Round II, Pool 3 was derived from the phage that remained on the beads in round 1 and those that were eluted by aprotinin in Round II, and Pool 4 was derived from the phage that remained on the beads in round 1 and those that remained on the beads in Round II.

A different strategy was invoked in Selection 2 in which phage (titer=$1 \times 10^{13}$ pfu) were first depleted of non-active site hK1 binders by incubating the phage three times for 1 hour with an immobilized hK1-aprotinin complex prepared by adding 25 µM aprotinin to 0.25 mL immobilized hK1 beads and brought to a total volume of 1 mL with PBST. The depleted phage were then added to 0.25 mL immobilized hK1 beads in 1 mL for 5 minutes and 12 wash cycles with PBST were performed. The phage that remained on the beads were then amplified, adjusted to a titer of $1 \times 10^{11}$ pfu and used as input for Round 2. Round 2 and 3 were performed as described for round 1 where each round had an initial depletion step against the hK1-aprotinin complex before selection against 0.25 mL immobilized hK1 beads. This selection strategy produced one phage population (Pool 5) that was screened by ELISA for binders to hK1.

Phage from the above five pools were assayed for their ability to bind hK1 by a soluble Fab ELISA. Prior to conducting this ELISA it was necessary to modify the phagemid DNA to permit the Fabs to be expressed without a gene II fusion. This DNA modification was done by first preparing phagemid DNA of each the five pools in *E. coli* TG1 cells, then performing a double DNA digest using the MluI restriction enzyme will release the DNA coding for the geneIII stump fragment. After gel purification, the vector was re-ligated (pMID21 vector without gene III stump) and electroporated into *E. coli* TG1 cells. Transformants were plated and colonies were picked and grown in 100 µL 2× YT in 96-well plates containing 100 µg/mL ampicillin and 0.1% glucose for about 3 hours at 30° C. Fabs were expressed upon addition of 1 mM Isopropylthio-β-galactoside (IPIG) for 16 hours at 30° C. Plates were then spun at 600 g for 10 min and 50 µL supernatant was used for the ELISA.

The soluble Fab ELISA was performed by first coating wells of a 96-well plate with 2 µg/mL streptavidin in 0.1 M sodium bicarbonate buffer, pH 9.6, overnight at 4° C. Following washing with PBST and blocking with 1% bovine serum albumin 10 ng of biotinylated hK1 was added and incubated for 1 hour at room temperature. Free hK1 was then removed by 5 washes with PBST. Supernatant (50 µL) from the above described Fab expression is added to the hK1 immobilized on the plate and incubated for 1 hour at room temperature. Unbound Fab is then removed by 7 washes with PBST and 100 µL of horse radish peroxidase conjugated anti-Fab antibody is added to the wells. Free secondary antibody is removed by seven washes with PBST and 100 µL of a colorimetric peroxidase substrate (3,3',5,5'-Tetramethylbenzidine/hydrogen peroxide) is added to permit the detection of bound Fab by an increase in absorbance at 630 nm. Using this ELISA 960 expressed Fabs were analyzed for each of the 5 selection pools for a total of 4800 Fabs analyzed.

5) DNA Sequencing

1152 ELISA positive soluble Fabs were DNA sequenced from which 335 Fabs had distinct heavy chains.

6) Determination of Fab Binding Affinity and Enzyme Inhibition Potency

The binding affinity of 335 Fabs was determined by surface plasmon resonance (SPR). Binding constants in the range of 0.4 to greater than 100 nM were obtained (Table 1).

The inhibition of enzyme activity was first screened for all 335 Fabs at a single Fab concentration of 120 nM, followed by the determination of IC50 values for a select number of Fabs (Table 1). Whether or not the Fabs for which no IC50 has been determined may or may not be enzyme inhibitors. The inhibitors may be further evaluated to determine their ability to inhibit bronchial tissue kallikrein activity present in bronchial alveolar lavage (BAL) fluid.

In addition, twenty four of the highest affinity Fabs found to inhibit hK1 were examined in further detail. An asterisk is used to indicate these Fabs in Table 1. These Fabs were initially identified using a combination of high-throughput SPR and enzyme inhibition screening using small quantities of Fabs purified using a novel high throughput method. Purification of larger quantities of these 24 Fabs using standard antibody purification methods permits a more accurate and detailed examination of their biochemical properties. Steady state enzyme inhibition assays were performed in black, 96 well, round bottomed microplates in a total volume of 100 μL of Reaction Buffer (20 mM Tris pH 7.5, 150 mM NaCl, 1 mM EDTA, 0.1% PEG, 0.1% Triton X-100) containing 5 nM hK1, a varied concentration of Fab and 100 μM Pro-Phe-Arg-AMC substrate. Before the addition of substrate to initiate the reaction, the hK1 and Fab were incubate in the well of the assay plate for 1 hour at 30° C. The substrate was then added and the reaction was monitored using a fluorescence plate reader (Gemini XS, Molecular Devices) using an excitation wavelength of 360 nm and an emission wavelength of 460 nm. Initial rates of substrate hydrolysis were plotted against inhibitor concentration and fit to the standard hyperbolic equation for enzyme inhibition by nonlinear regression to provide $IC_{50}$ estimates.

Specific exemplary antibodies are designated in the form of M0103-A01. All the names begin "M0", hence the names are sometimes shortened by removal of the lead "M0". The antibody name "103-A01" refers to the same antibody as does "M0103-A01". The HC of M0103-A01 is named HC-103-A01 and the LC is named LC-103-A01.

7) Mouse Model of Airway Inflammation Studies

Fab's can be evaluated for ability to modulate airway inflammation in a mouse model of asthma, e.g., as described in Kips et al., (2003) "Murine models of asthma" Eur. Respir. J. 22, 374-382. Fabs may also be reformatted as IgG molecules and evaluated using one or more assays described herein.

TABLE 1

| Name | Binding Data | | | |
|---|---|---|---|---|
| | IC50 (nM) | kon (M-1s-1) | koff (s-1) | Kd (M) |
| *098-E09 | 2.5 ± 3.3 | 8.36E+05 | 1.59E-03 | 1.91E-09 |
| *131-F07 | 0.35 ± 0.58 | 2.46E+05 | 2.09E-04 | 8.47E-10 |
| *139-F04 | 20.7 ± 8.7 | 1.84E+05 | 1.34E-03 | 7.27E-09 |
| *139-E12 | 2.9 ± 0.49 | 1.25E+05 | 2.33E-04 | 1.87E-09 |
| *097-F03 | 1.1 ± 0.54 | | | |
| *102-G12 | 3.3 ± 0.34 | 8.37E+04 | 4.42E-04 | 5.28E-09 |
| *102-E09 | 0.89 ± 0.25 | | | |
| *106-G12 | 5.1 ± 0.4 | | | |
| *102-H11 | 4.5 ± 1.7 | 2.29E+06 | 7.41E-03 | 3.24E-09 |
| *138-C09 | 10.9 ± 3.9 | 1.75E+05 | 1.53E-03 | 8.78E-09 |
| *098-G05 | 4.0 ± 2.2 | | | |
| *133-E02 | 2.4 ± 1.1 | 2.27E+05 | 1.46E-03 | 6.42E-09 |
| *112-D03 | 6.0 ± 0.3 | 1.04E+05 | 9.88E-04 | 9.51E-09 |
| *098-F02 | 6.9 ± 1.6 | 5.36E+05 | 6.22E-04 | 1.16E-09 |
| 136-E10 | 22 | 1.10E+05 | 1.06E-03 | 9.66E-09 |
| 136-A07 | 25 | 3.23E+05 | 2.58E-03 | 7.98E-09 |
| *097-G01 | 7.2 ± 3.0 | 1.73E+05 | 8.32E-04 | 4.80E-09 |

TABLE 1-continued

| Name | Binding Data | | | |
|---|---|---|---|---|
| | IC50 (nM) | kon (M-1s-1) | koff (s-1) | Kd (M) |
| 138-G11 | 28 | 2.60E+05 | 1.61E-03 | 6.19E-09 |
| 139-A09 | 34 | 1.94E+05 | 1.06E-03 | 5.48E-09 |
| *114-G06 | 1.2 ± 0.53 | 1.67E+05 | 1.66E-04 | 9.99E-10 |
| *139-C02 | 1.0 ± 0.30 | | | |
| *093-F09 | 2.5 ± 2.13 | 6.00E+05 | 2.79E-03 | 4.66E-09 |
| 110-F08 | 44 | | | |
| *117-F04 | 5.2 ± 1.5 | 2.98E+05 | 1.97E-03 | 6.61E-09 |
| 111-D11 | 160 | | | |
| 112-D07 | >120 | 1.34E+05 | 7.81E-04 | 5.81E-09 |
| 131-B05 | | 2.55E+05 | 1.17E-04 | 4.60E-10 |
| 131-D01 | | 3.11E+05 | 3.25E-04 | 1.04E-09 |
| *137-E01 | 0.4 ± 0.25 | 1.23E+05 | 1.58E-04 | 1.29E-09 |
| 132-C08 | | 3.42E+05 | 4.44E-04 | 1.30E-09 |
| 114-G09 | | 4.24E+05 | 6.20E-04 | 1.46E-09 |
| 138-A03 | | 1.90E+05 | 3.25E-04 | 1.71E-09 |
| 135-H01 | | 1.95E+05 | 3.96E-04 | 2.03E-09 |
| 108-D11 | | 3.30E+05 | 6.90E-04 | 2.09E-09 |
| 136-E12 | | 4.81E+05 | 1.07E-03 | 2.23E-09 |
| 136-D07 | | 1.76E+05 | 3.97E-04 | 2.26E-09 |
| 138-E02 | | 6.14E+05 | 1.38E-03 | 2.26E-09 |
| 131-F09 | | 3.11E+05 | 7.34E-04 | 2.36E-09 |
| 134-B03 | | 3.99E+05 | 9.60E-04 | 2.41E-09 |
| 104-H12 | | 5.67E+05 | 1.38E-03 | 2.43E-09 |
| 135-F03 | | 2.35E+05 | 6.25E-04 | 2.66E-09 |
| *134-D07 | 10.1 ± 5.1 | 5.13E+04 | 1.38E-04 | 2.69E-09 |
| 135-C12 | | 1.21E+05 | 3.76E-04 | 3.10E-09 |
| 097-F04 | | 1.06E+05 | 3.46E-04 | 3.26E-09 |
| 111-C10 | | 1.04E+06 | 3.41E-03 | 3.29E-09 |
| 094-E08 | | 1.59E+05 | 5.30E-04 | 3.34E-09 |
| 138-B10 | | 2.65E+05 | 8.90E-04 | 3.36E-09 |
| 139-F09 | | 3.01E+05 | 1.08E-03 | 3.60E-09 |
| 104-A12 | | 6.73E+05 | 2.46E-03 | 3.66E-09 |
| 132-D02 | | 7.17E+05 | 3.03E-03 | 4.22E-09 |
| 138-C04 | | 1.71E+05 | 7.28E-04 | 4.26E-09 |
| 132-H11 | | 4.40E+05 | 1.98E-03 | 4.50E-09 |
| 132-D08 | | 1.95E+05 | 9.23E-04 | 4.73E-09 |
| 121-A07 | | 9.22E+05 | 4.38E-03 | 4.75E-09 |
| 126-F11 | | 2.85E+05 | 1.44E-03 | 5.05E-09 |
| 098-H04 | | 4.61E+05 | 2.55E-03 | 5.53E-09 |
| 093-C02 | | 1.80E+05 | 1.03E-03 | 5.72E-09 |
| 115-G12 | | 1.51E+05 | 8.65E-04 | 5.73E-09 |
| 135-B05 | | 1.11E+05 | 6.55E-04 | 5.90E-09 |
| 136-F08 | | 4.76E+05 | 2.84E-03 | 5.97E-09 |
| 110-H11 | | 9.75E+05 | 6.01E-03 | 6.17E-09 |
| 110-D11 | | 2.10E+05 | 1.34E-03 | 6.38E-09 |
| 114-H07 | | 1.10E+06 | 7.03E-03 | 6.39E-09 |
| 098-E01 | | 1.48E+05 | 1.01E-03 | 6.80E-09 |
| 135-C11 | | 3.37E+05 | 2.31E-03 | 6.85E-09 |
| 095-A11 | | 5.25E+05 | 3.79E-03 | 7.22E-09 |
| 092-F08 | | 2.18E+05 | 1.58E-03 | 7.27E-09 |
| 104-B12 | | 2.30E+05 | 1.71E-03 | 7.41E-09 |
| 109-A11 | | 4.70E+05 | 3.50E-03 | 7.45E-09 |
| 131-G03 | | 3.41E+05 | 2.56E-03 | 7.49E-09 |
| 135-E10 | | 2.72E+05 | 2.06E-03 | 7.57E-09 |
| 130-B02 | | 3.94E+05 | 3.07E-03 | 7.80E-09 |
| 097-D04 | | 2.03E+05 | 1.68E-03 | 8.28E-09 |
| 093-G06 | | 3.72E+05 | 3.13E-03 | 8.40E-09 |
| 108-E11 | | 4.18E+05 | 3.55E-03 | 8.50E-09 |
| 127-C06 | | 6.62E+05 | 5.75E-03 | 8.69E-09 |
| 105-B06 | | 4.09E+05 | 3.60E-03 | 8.81E-09 |
| 107-D01 | | 8.96E+05 | 8.12E-03 | 9.06E-09 |
| 107-F11 | | 6.80E+05 | 6.60E-03 | 9.71E-09 |
| 101-E01 | | 9.66E+04 | 9.41E-04 | 9.74E-09 |
| 138-E12 | | 1.48E+05 | 1.49E-03 | 1.00E-08 |
| 109-E08 | | 8.80E+05 | 8.89E-03 | 1.01E-08 |
| 104-B03 | | 7.07E+05 | 7.11E-03 | 1.01E-08 |
| 096-E11 | | 8.27E+05 | 8.36E-03 | 1.01E-08 |
| 103-A03 | | 9.31E+05 | 9.88E-03 | 1.06E-08 |
| 099-A09 | | 2.67E+05 | 2.85E-03 | 1.07E-08 |
| 105-F02 | | 9.47E+05 | 1.03E-02 | 1.09E-08 |
| 112-C02 | | 4.81E+05 | 5.23E-03 | 1.09E-08 |
| 125-C04 | | 4.78E+05 | 5.36E-03 | 1.12E-08 |
| 122-H04 | | 6.82E+04 | 8.02E-04 | 1.18E-08 |
| 092-B12 | | 1.41E+05 | 1.71E-03 | 1.21E-08 |
| 139-A04 | | 4.11E+05 | 5.03E-03 | 1.22E-08 |

TABLE 1-continued

Binding Data

| Name | IC50 (nM) | kon (M-1s-1) | koff (s-1) | Kd (M) |
|---|---|---|---|---|
| 108-C10 | | 3.53E+05 | 4.31E-03 | 1.22E-08 |
| 138-B06 | | 6.64E+04 | 8.29E-04 | 1.25E-08 |
| 137-B01 | | 1.92E+05 | 2.40E-03 | 1.25E-08 |
| 111-B02 | | 9.29E+10 | 1.17E+03 | 1.27E-08 |
| 129-B09 | | 1.73E+06 | 2.20E-02 | 1.27E-08 |
| 099-C12 | | 3.54E+05 | 4.61E-03 | 1.30E-08 |
| 099-E11 | | 6.05E+05 | 7.96E-03 | 1.32E-08 |
| 103-F07 | | 5.64E+05 | 7.43E-03 | 1.32E-08 |
| 102-A04 | | 3.27E+05 | 4.35E-03 | 1.33E-08 |
| 119-B09 | | 3.52E+05 | 4.83E-03 | 1.37E-08 |
| 097-E07 | | 5.85E+05 | 8.15E-03 | 1.39E-08 |
| 117-A12 | | 2.43E+05 | 3.45E-03 | 1.42E-08 |
| 126-C10 | | 4.51E+05 | 6.48E-03 | 1.44E-08 |
| 127-D05 | | 6.39E+04 | 9.21E-04 | 1.44E-08 |
| 126-B12 | | 3.85E+05 | 5.79E-03 | 1.50E-08 |
| 122-G06 | | 7.08E+05 | 1.07E-01 | 1.52E-08 |
| 107-D05 | | 1.95E+05 | 3.00E-03 | 1.53E-08 |
| 127-H05 | | 2.87E+05 | 4.39E-03 | 1.53E-08 |
| 112-C12 | | 2.90E+05 | 4.65E-03 | 1.60E-08 |
| 098-C10 | | 1.20E+05 | 1.93E-03 | 1.61E-08 |
| 095-H10 | | 5.56E+05 | 9.18E-03 | 1.65E-08 |
| 117-C04 | | 2.01E+05 | 3.34E-03 | 1.66E-08 |
| 094-F03 | | | 6.44E-03 | 1.67E-08 |
| 124-G12 | | 3.72E+05 | 6.40E-03 | 1.72E-08 |
| 131-A03 | | 2.65E+06 | 4.60E-02 | 1.74E-08 |
| 099-D05 | | 3.31E+05 | 5.78E-03 | 1.75E-08 |
| 131-C08 | | 2.64E+05 | 4.66E-03 | 1.77E-08 |
| 116-C09 | | 5.20E+05 | 9.47E-03 | 1.82E-08 |
| 128-F11 | | 7.80E+05 | 1.43E-02 | 1.83E-08 |
| 131-D12 | | 1.05E+05 | 1.93E-03 | 1.84E-08 |
| 128-A06 | | 3.32E+05 | 6.12E-03 | 1.84E-08 |
| 095-G09 | | 5.01E+06 | 9.34E-02 | 1.86E-08 |
| 137-G10 | | 2.72E+05 | 5.13E-03 | 1.88E-08 |
| 106-E12 | | 1.23E+08 | 2.44E+00 | 1.99E-08 |
| 124-H10 | | 5.91E+04 | 1.20E-03 | 2.03E-08 |
| 122-D01 | | 2.05E+05 | 4.27E-03 | 2.08E-08 |
| 093-C10 | | 3.33E+05 | 7.52E-03 | 2.26E-08 |
| 106-C06 | | 6.28E+05 | 1.42E-02 | 2.26E-08 |
| 117-B07 | | 3.62E+05 | 8.26E-03 | 2.28E-08 |
| 126-H09 | | 1.80E+07 | 4.15E-01 | 2.30E-08 |
| 093-G09 | | 4.58E+05 | 1.05E-02 | 2.30E-08 |
| 114-E02 | | 4.03E+05 | 9.36E-03 | 2.32E-08 |
| 102-G11 | | 4.67E+05 | 1.16E-02 | 2.48E-08 |
| 132-C01 | | 1.37E+05 | 3.50E-03 | 2.56E-08 |
| 123-E02 | | 2.29E+05 | 6.13E-03 | 2.68E-08 |
| 096-D03 | | 3.37E+05 | 9.45E-03 | 2.81E-08 |
| 131-G06 | | 7.03E+04 | 2.09E-03 | 2.97E-08 |
| 094-D08 | | 2.37E+05 | 7.07E-03 | 2.98E-08 |
| 128-E07 | | 4.83E+05 | 1.47E-02 | 3.04E-08 |
| 114-F04 | | 3.48E+05 | 1.07E-02 | 3.07E-08 |
| 122-A05 | | 1.47E+05 | 4.53E-03 | 3.08E-08 |
| 102-H02 | | 3.40E+05 | 1.05E-02 | 3.08E-08 |
| 092-G06 | | 2.15E+05 | 6.63E-03 | 3.09E-08 |
| 113-E03 | | 1.59E+10 | 5.00E+02 | 3.15E-08 |
| 118-E07 | | 2.74E+06 | 8.71E-02 | 3.18E-08 |
| 093-E11 | | 1.34E+06 | 4.36E-02 | 3.24E-08 |
| 124-C12 | | 3.89E+06 | 1.26E-01 | 3.25E-08 |
| 115-F08 | | 4.84E+05 | 1.58E-02 | 3.26E-08 |
| 121-H07 | | 1.68E+05 | 5.50E-03 | 3.28E-08 |
| 136-B06 | | 2.00E+05 | 6.61E-03 | 3.30E-08 |
| 097-F08 | | 3.53E+05 | 1.17E-02 | 3.31E-08 |
| 107-B05 | | 6.00E+05 | 2.03E-02 | 3.38E-08 |
| 124-A01 | | 3.36E+05 | 1.14E-02 | 3.39E-08 |
| 102-C12 | | 7.39E+07 | 2.62E+00 | 3.54E-08 |
| 103-E09 | | 2.43E+05 | 8.84E-03 | 3.64E-08 |
| 131-F12 | | 1.28E+05 | 4.72E-03 | 3.70E-08 |
| 093-C08 | | 1.42E+05 | 5.78E-03 | 4.07E-08 |
| 115-F04 | | 3.14E+05 | 1.31E-02 | 4.16E-08 |
| 113-G11 | | 2.86E+05 | 1.21E-02 | 4.25E-08 |
| 102-C02 | | 1.44E+05 | 6.28E-03 | 4.35E-08 |
| 112-D04 | | 1.76E+05 | 9.56E-03 | 5.42E-08 |
| 108-E10 | | 2.30E+05 | 1.34E-02 | 5.84E-08 |
| 104-D12 | | 3.14E+05 | 1.92E-02 | 6.13E-08 |
| 116-E08 | | 2.25E+05 | 1.64E-02 | 7.27E-08 |
| 102-D07 | | 1.55E+05 | 1.22E-02 | 7.86E-08 |
| 103-H07 | | 1.00E+05 | 8.60E-03 | 8.57E-08 |
| 116-A08 | | 1.13E+05 | 9.94E-03 | 8.83E-08 |
| 106-D06 | | 1.54E+05 | 1.90E-02 | 1.23E-07 |
| 113-D05 | | 1.41E+04 | 2.14E-03 | 1.52E-07 |
| 110-D06 | | 7.56E+04 | 1.75E-02 | 2.32E-07 |
| 124-C04 | | 7.68E+05 | 2.86E-01 | 3.72E-07 |
| *111-C12 | 2.9 ± 1.1 | | | |
| *107-D12 | 1.7 ± 3.2 | | | |
| *109-F02 | 2.8 ± 0.2 | | | |

The exemplary antibodies include the following sequences:

The following are amino acids sequences of exemplary light-chain variable regions:

```
>LC-092-B12 (SEQ ID NO:1022)
AQDIQMTQSP SSLSASVGDR VTITCPASQG ISNYLAWYQQ
KPGKVPKLLI YAASTLQSGV PSRFSGSGSG TDFTLTISSL
QPEDFATYYC QQSYSTPYTF GQGTKLEVRR TVAAP

>LC-092-F08 (SEQ ID NO:1023)
AQDIQMTQSP ATLSLSPGER ATLSCGASQS VSSSYLAWYQ
QKPGLAPRLL IYDASSRATG IPDRFSGSGS GTDFTLTISS
LQPEDFATYY CLHDYNFPFT FGPGTKVDIK RTVAAP

>LC-092-G06 (SEQ ID NO:1024)
AQSELTQPRS VSGSPGQSVT ISCTGTSGEV ANYNYVSWYH
QDPGLVPKLK IYDVSRRPSG VPDRFSGAKS GDTASLTISG
LQAEDEGDYY CASYVGNDKL VFGGGTKLTV LGQPKAAP

>LC-093-C02 (SEQ ID NO:1025)
AQDIQMTQSP GTLSLSPGDR ATLSCRASQS VGSDYLAWYQ
QKPGQAPRLL IFAASTRATG IPDRFSGSGS ATDFTLTISS
LEPEDFAVYF CQQYASPPRT FGQGTKVEIK RTVAAP

>LC-093-C08 (SEQ ID NO:1026)
AQDIQMTQSP GTLSLSPGER ATLSCRASQS VSSSYLAWYQ
QKPGQAPRLL IFAASTRATG IPDRFSGSGS ATDFTLTISS
LEPEDFAVYY CQQRSNWPPE LTFSGGTKVE IKRTVAAP

>LC-093-C10 (SEQ ID NO:1027)
AQDIQITQSP SSLSASVGDR VTITCRASQG ISNYLAWYQQ
KPGKVPKLLI YAASTLQSGV PSRFSGSGSG TDFTLTISSL
QPEDFATYYC EQLNSFPHAF GQGTKVEIKR TVAAP

>LC-093-E11 (SEQ ID NO:1028)
AQDIQMTQSP ATLSLSPGER ATLSCRASQS VSSYLAWYQQ
KPGQAPRLLI YDASNRATGI PARFSGSGSG TDFTLTISSL
EPEDFAVYYC QQRSNWLTFG GGTKVEIKRT VAAP

>LC-093-F09 (SEQ ID NO:1029)
AQSALTQPAS VSGSPGQSIT ISCTGTSTDD VGGYNYVSWY
QQHPGKAPKL MIYDVINRPS GVSNRFSGSK SGNTASLTIS
GLQAEDEADY YCSSYTSRGT RVFGTGTKVT VLGQPKANP

>LC-093-G06 (SEQ ID NO:1030)
AQSALTQPRS VSGSLGQSVT ISCTGSTSDV GGYTYVSWYQ
QEPGKAPKLM IHDVSKRPSG VPDRFSGSKS GNTASLIISG
LQAEDEADYY CCSYAGSYSY VFGTGTKVTV LGQPKANP

>LC-093-G09 (SEQ ID NO:1031)
AQDIQMTQSP SSLSASVGDR VTITCRASQS ISSFLNWYQQ
KPGKAPKLLL MYAASSLQSG VPSRFSGSGS GTDFTLTISS
LQPEDFATYY CQQSYSTPYT FGQGTKLEIK RTVAAP

>LC-094-D08 (SEQ ID NO:1032)
AQSALTQPPS ASGTPGQRVT ISCSGSSSNI GSNNVNWYQQ
LPGTAPKLLI YSNDQRPSGV PDRFSGSKSA TSASLAISGL
QSEDEADYHC AAWDDSLNGP VFGGGTKLTV LGQPKAAP

>LC-094-E08 (SEQ ID NO:1033)
```

-continued

```
AQSVLTQPAS VSGSPGQSIT ISCTGTSSDV GAYNYVSWYQ
QHPGKVPELM IYDVSNRPSG VSHRFSGSKS CNTASLTISG
LQAEDDADYY CSSFTSRKTW VFGTGTKVTV LGQPKANP

>LC-094-F03 (SEQ ID NO:1034)
AQDIQMTQSP GTLSLSLGET ATLSCRASQT VGGSYLAWYR
QKPGQAPSLL IYAASNRAPG IPDRFSGSGS GTDFTLTISS
LQSEDFAVYY CQQYGSSMYT FGQGTILEIK RTVAAP

>LC-095-A11 (SEQ ID NO:1035)
AQDIQMTQSP ATLSLSPGER ATLSCRASQS VSSYLAWYQQ
KPGQAPRLLI YDASNRATGI PARFSGSGSG TDFTLTISSL
EPEDFAVYYC QQRSNWPPYT FGQGTKLEIK RTVAAP

>LC-095-G09 (SEQ ID NO:1036)
AQDIQMTQSP SSLSASVGDR VTITCRASQS ISNWLAWYQQ
KPGKAPKLLI YKASTLQTGV PSRFSGSGSG TEFSLTISSL
QPDDFATYYC QQTYSAPFNF GPGTKVDIKR TVAAP

>LC-095-H10 (SEQ ID NO:1037)
AQDIQMTQSP STLSASVGDR VTITCRASQS ISSWLAWYQQ
KPGKAPKLLI YTASSLESGV PSRFSAGGSG TEFTLTISSL
QPDDFGTYYC QQYNSYSLTF GGGTKVEIKR TVAAP

>LC-096-D03 (SEQ ID NO:1038)
AQSELTQPRS VSGSPGQSVT ISCTGTTRDV GAYKYVSWYQ
QYPGKAPKLM LSDVSKRPSG VPDRFSGSKS GNTASLTISG
LQSEDEADYY CCSFAGSYTW IFGGGTKVTV LGQPKAAP

>LC-096-D09 (SEQ ID NO:1039)
AQSALTQPPS ASGTPGQRVT ISCSGSSSNI GTNRVNWYQQ
IPGTAPKLLI YSNNQRPSGV PDRFSDSKSG TSASLAISGL
qSEDEADYYC AAWDDSLNGV VFGGGTKLTV LGQPKAAP

>LC-096-E11 (SEQ ID NO:1040)
AQDIQMTQSP LSLSASVGDR VTMTCRASQT ISSYLNWYQQ
KPGKAPKLLI YTTSSLQSGV PSRFSGSGSG TEFTLTISSL
QPEDFATYYC QQSHSSPTFG GGTKVEIKRT VAAP

>LC-097-D04 (SEQ ID NO:1041)
AQSELTQPPS ASGTPGQRVT ISCSGSSSNI GSNYVYWYQQ
LPGMAPKLLI YRNNQRPSGV PDRFSGSKSG TSASLAISGL
RSEDEADYYC AAWDDSMSGV VFGGGTKLTV LSQPKAAP

>LC-097-E07 (SEQ ID NO:1042)
AQDIQMTQSP SSLSASVGDR VTITCRASQS ISSYLSWFQQ
RPGKAPKLLI YSASNLQSGV PLRFSGSGSG TDFTLTISSL
QPEDFATYYC QQIYRTPLTF GGGTKVEIKR TVAAP

>LC-097-F03 (SEQ ID NO:1043)
AQDIQMTQSP ATLSVSPGGR ATLSCRASQS VRKNVAWYQQ
KPGQPPRLLI YGASTRATGV PARFSGSGSG TEFTLTISRM
QPEDFVVYHC QQYSSWPAFG QGTMVEINRT VAAP

>LC-097-F04 (SEQ ID NO:1044)
AQYELTQPPS ASGTPGQRVT ISCSGSSSNI GSNYVHWYQQ
LPGTAPKLLI YRNNRRPSGV PDRFSGSKSG TSASLAISGL
RSEDEADYYC AAWDDSLSGL VVFGGGTKLT VLGQPKAAP

>LC-097-F08 (SEQ ID NO:1045)
AQDIQMTQSP STLSASVGDR VTISCRASQG IGTHLNWYQQ
KLGNVPKLLI YAASGLQSGV PPRFSGSGSG TDFTLTISSL
HPEDSATYFC QQSYSVPRTF GQGTKVEIKR TVAAP

>LC-097-G01 (SEQ ID NO:1046)
AQDIQMTQSP SSLSASVGDR VTITCRASQG IGNYLVWYQH
KPGNVPRVLI YAASTLQSGV PSRFRGSGSG TDFTLTISGL
QPEDVATYYC QKYDGAPFTF GPGTKVDLKR TVAAP

>LC-097-G07 (SEQ ID NO:1047)
AQDIQMTQSP FLPVCILqET ESPSLAGQVR PLAGILNWYQ
QKPGTAPKLL IYAASSLQSG VPSRFSGDGS GTDFTLTISS
LQPEDFGIYF CQQSYSAPRT FGQGTKVEIK RTVAAP

>LC-098-C10 (SEQ ID NO:1048)
AQDIQMTQSP SSLSASVGDR VTITCRASHN IYTSLNWLQQ
KPGKAPKLLI YGASTLENGV PSRFSGSASG TDFTLTISSL
QPEDSATYYC QQSYTSVTFG QGTKLEIRRT VAAP

>LC-098-E10 (SEQ ID NO:1049)
AQDIQMTQSP ATLSLSPGER ATLSCRASQS VSGFLAWYQQ
KPGQAPRLLI YDASNRATGI PARFSGSGSG TDFTLTITRL
EPEDFAVYYC QQYGDSSPIT FGPGTRLEIK RTVAAP

>LC-098-E09 (SEQ ID NO:1050)
AQDIQMTQSP SSVSASVGDS VTISCWTIYD ISSWLAWYQQ
RPGQAPKLLI YAASRLATGV PSRFRGSGSG TDFTLTITNL
QPEDVATYYC QQTKDFPLTF GGGTRVDLKR TVAAP

>LC-098-G05 (SEQ ID NO:1051)
AQDIQMTQSP SSLSASVGDR VTITCRASQT ISRYLNWYQQ
KPGTAPKLLI YAASSLQSGV PSRFSGDGSG TDFTLTISSL
QPEDFGIYFC QQSYSAPRTF GQGTKVEIKR TVAAP

>LC-098-H04 (SEQ ID NO:1052)
AQSELTQPPS ASGSPGQSLT ISCTGGRRDI GNYNYVSWYQ
QHPGKAPRLI IYDVRKRPSG VPDRFSGSKS GNVAFLTVSG
LQTDDEADYY CGSYTGTSNV FGSGTTVTVL GQPKANP

>LC-131-G03 (SEQ ID NO:1052)
LC-098-H04 is same as LC-131-G03
AQSELTQPPS ASGSPGQSLT ISCTGGRRDI GNYNYVSWYQ
QHPGKAPRLI IYDVRKRPSG VPDRFSGSKS GNVAFLTVSG
LQTDDEADYY CGSYTGTSNV FGSGTTVTVL GQPKANP >LC-099-A09 (SEQ ID NO:1053)
AQDIQMTQSP GTLSLSPGER ATLSCRASQS VYSSYLAWYQ
QKPGQAPRLL IYAASNRAIG IPDRFSGSGS GTDFTLTISS
MQPEDFATYY CQQSYSTPRF GQGTKLEIKR TVAAP >LC-099-C12 (SEQ ID NO:1054)
AQSVLTQPAS VSGSPGQSIT ISCTGTTSDV GGYKYVSWYQ
HHPGKVPKLI IYEVNHRPSG VSHRFSGSKS GNTASLIISA
LQAEDEADYY CYSYTSDSTP YVFGTGTKVT VLGQPKANP >LC-099-D05 (SEQ ID NO:1055)
AQDIQMTQSP GTLSLSPGER ATLSCRASQT VSSNYLAWYQ
QKPGLAPRLL IYGVSNRAAG IPDRFSGRGS GTDFTLIINR
LEPEDFAVYY CQHYGSSAFT FGRGTKLEIE RTVAAP >LC-099-E11 (SEQ ID NO:1056)
AQDIQMTQSP STLSASVGDR VTITCRASQS ISNWLAWYQQ
KPGRAPKLLI YKASTLESGV PSRFSGSGSG TEFTLTISSL
QPDDFATYYC QHYNSYSLFG QGTKLEIKRT VAAP >LC-101-E01 (SEQ ID NO:1057)
AQDIQMTQSP SSVSASVGDR VTITCRAGQN IYYWLAWYQQ
KPGKAPQLLI YAASSLQSGV PSRFSGSGSG TDFTLTISSL
QPEDFATYYC QQAKSFPVTF GGGTKVEIKR TVAAP >LC-102-A04 (SEQ ID NO:1058)
AQSELTQPPS ASGTPGQRVT ISCSGSSSNI GSNYVYWYQQ
YPGTVPKLLI HSNNQRPSGV PDRFSGPKSG TSASLAISGL
RSEDEADYYC ATWDNSLSAW VFGGGTKLTV LRQPKAAP >LC-102-C02 (SEQ ID NO:1059)
AQDIQMTQSP SSLSASVGDR VTITCRASQG ISSSLAWYQQ
KPGKVPKLLI YAASTLQSGV PSRFSGSGSG TDFTLTISSL
QPEDFATYYC QQSYSTPWTF GQGTKVEIKR TVAAP >LC-102-C12 (SEQ ID NO:1060)
AQDIQMTQSP SSLSASVGDR VTITCRASQG ISNYLAWYQQ
KPGKVPKLLI YAASTLQSGV PSRFSGSGSG TDFTLTISSL
QPEDVATYYC QKYNSAPWTF GQGTKVEIKR TVAAP >LC-102-D07 (SEQ ID NO:1061)
AQDIQMTQSP GTLSLSPGER ATLSCGASQS VSTTYIAWYQ
HKPGQPPRLL IYGASNRATG IPDRFGSGS GTDFTLTISR
LEPEDFAVYY CQQYGSSPYT FGQGTKLEIK RTVAAP >LC-102-E09 (SEQ ID NO:1062)
AQDIQMTQSP DSLSLSPGER ATLSCRASQS ISSSYLAWYQ
QTPGQAPRLL IYHASSRATG VPARFSGSGS GTDFTLTISS
LEPEDFAVYY CQQRNNWPPS FTFGGGTKVE TKRTVAAP
```

```
>LC-102-G11 (SEQ ID NO:1063)
AQDIQMTQSP DTLSLSPGER ATLSCRASES VSSSYFAWYQ
QKRGQAPRLL IYGASRRVTG IPDRFSGSGS GTDFTLTITR
LEPEDFAVYY CQQYGGSPRS FGQGTKVEIK RTVAAP
>LC-102-G12 (SEQ ID NO:1064)
AQSELTQPPS ASGTPGQRVT ISCSGTLSNI GTNIVSWFQQ
LPGTAPKLLI YNDHRRPSGV PDRFSGSKSA TSASLAISGL
QSEDEADYYC AAWDDSLNGV VFGGGTKLTV LSQPKAAP

>LC-133-E08 (SEQ ID NO:1064)
LC-102-G12 identical to LC-133-E08
AQSELTQPPS ASGTPGQRVT ISCSGTLSNI GTNIVSWFQQ
LPGTAPKLLI YNDHRRPSGV PDRFSGSKSA TSASLAISGL
QSEDEADYYC AAWDDSLNGV VFGGGTKLTV LSQPKAAP >LC-102-H02 (SEQ ID NO:1065)
AQDIQMTQSP ATLSLSPGER AALSCRASQS VSNFLAWYQQ
KPGQAPRLLI YGASNRATDI PARFSGSGSG TDFTLTISSL
EPEDFATYYC QQANSFPLTF GGGTKVEIKR TVAAP >LC-102-H11 (SEQ ID NO:1066)
AQDIQMTQSP ATLSLSPGER ATLSCRASQS VSSYLAWYQQ
KPGQAPRLLI YGASSRATGI PDRFSGSGSG TDFTLTISSL
EPEDFAVYYC QQRGGWPLTF GGGTKVEIRR TVAAP >LC-103-A01 (SEQ ID NO:1067)
AQSALTQPPS ASGTPGQTVT ISCSGSSSNI GTNFVYWYQQ
LPGTAPKLLI YRSIKRPSGV PDRFSGSKSG TSASLAISGL
RSEDEADYYC AAWDDSLSGV VFGGGTKLTV LGQPKAAP >LC-103-A03 (SEQ ID NO:1068)
AQDIQMTQSP SSVSASVGDR VTITCRASQD VRRFLAWYQQ
KPGKAPKLLI YAASSLQSGV PSRFSGSGSG TDFTLTISSL
QPEDFATYYC QQANSFPITF GQGTRLEIKR TVAAP >LC-103-E09 (SEQ ID NO:1069)
AQYELTQPAS VSGSPGQSIT ISCTGTNTDV GGYNFVSWYQ
QYPGKAPKLI IFDVTNRPSG VSNRFSGSKS GNTASLTISG
LQAEDEADYY CCSYTNTNTL VFAGGTKVTV LGQPKANP >LC-103-F07 (SEQ ID NO:1070)
AQSALTQPAS VSGSPGQSIT ISCTGTSNDI GRTNYVSWYR
QDPGRAPKLI LFEVSNRPSG ISNRFSASKS GSTASLTISG
LQADDESDYY CSSCTTAPVC VFGNGTRVTV LGQPKANP >LC-103-H07 (SEQ ID NO:1071)
AQDIQMTQSP SSLSASVGDR VAITCRASQS IDTYLNWYQQ
KPGKAPKLLI YAASKLEDGV PSRFSGSGTG TDFTLTIRSL
QPEDFATYYC QPYNTYPITF GQGTRLEIKR TVAAP >LC-104-A12 (SEQ ID NO:1072)
AQDIQMTQSP SSLSASVGDR VTITCRASQS IGASLNWYQQ
KPQKAPKLLI YTASNLQSGV PSRFSGSGSG TDFTLTISSL
LPEDFATYYC QQNYRGRTFG QGTKLEIKRT VAAP >LC-104-B03 (SEQ ID NO:1073)
AQDIQMTQSP GTLSLSPGER ATLSCRASQS VSSSYLAWYQ
QKPGQAPRLL IYGASSRATG IPDRFSGSGS GTDFTLTISR
LEPEDFAVYY CQQYGSSRYT FGQGTKLEIK RTVAAP >LC-104-B12 (SEQ ID NO:1074)
AQDIQMTQSP SSLSASVGDR VTITCRASQA ISNYLAWYQQ
QPGKVPKLLI SAASTLQSGV PSRFSGSGSG TDFTLSISSL
QPEDVATYYC QTYYSVPFTF GPGTKVDFKR TVAAP >LC-104-D12 (SEQ ID NO:1075)
AQDIQMTQSP SSLSASVGDR VTITCRASLS VSGYLNWYQH
KPGRAPNLLI YATSSLQSGV PSRFSGSGSG TDFTLTVSSL
QPEDLATYYC QQSYSSPYTF GQGTKVEIKG TVAAP >LC-104-H12 (SEQ ID NO:1076)
AQSELTQPPS ASGSPGQSVT ISCTGTSSDV GAYNYVSWYQ
QHPGKAPKLI IYEVNKRPSG VPDRFSASKS GNTASLTVSG
LQAEDEADYY CNSYAGSNSL IFGGGTKLTV LGQPKAAP >LC-105-B06 (SEQ ID NO:1077)
AQDIQMTQSP SSLSASVGDR VTLTCRASQS IANYLNWYQQ
KPGKAPKLLV YAASRLHSGV PSRFSGRGSG TDFTLTITSL
EPDDLATYYC QQSHASPLTF GGGTKVEIKR TVAAP >LC-105-F02 (SEQ ID NO:1078)
AQDIQMTQSP STLSASVGDR VTITCRASQS ISSWLAWYQQ
KPGEAPKLLI YAASSLRNGV PSRFIGSGSG TDFTLTISSL
QPEDFATYYC QQSYSTPPTF GGGTKVEIKR TVAAP >LC-106-C06 (SEQ ID NO:1079)
AQDIQMTQSP ATLSASVGDR VTITCRASQS VSRWLAWYQQ
KPGKAPKLLI YKASTLESGV PSRFSGSGSG TEFTLTISSL
QPDDFATYYC QQYGAFGQGT KVEIRRTVAA P >LC-106-D06 (SEQ ID NO:1080)
AQDIQMTQSP SSVSASVGDR VTITCRASQS ISSWLAWYQQ
KPGKAPKLLI YAASSLQSGV PSRFSGSGSG TDFTLTISSL
QPEDFATYYC QQANSFPYTF GQGTKLEIKR TVAAP >LC-106-E12 (SEQ ID NO:1081)
AQDIQMTQSP GTLSLSPGER ATLSCRPSQS VYSNYLAWYQ
QKPGQAPRLL IYGASTRATG IPDRFSGSAS GTDFTLTISR
LEPEDFAVYY CQQYGNSYTF GPGTKVDIKR TVAAP >LC-106-G12 (SEQ ID NO:1082)
AQDIQMTQSP SFVSASIGDR VTITCRASQS IGTLLNWYQH
KPGTVPSLLI YGASNLRGGV PARFSGSGSG TDFTLTISSL
QPEDFATYYC QHDTFGGGTK VDIKRTVAAP >LC-107-B05 (SEQ ID NO:1083)
AQSELTQPAS VSGSPGQSIT ISCTGTSSDV GAYNYVSWYQ
QHPGKVPKLM IYEVSNRPSG VSNRFSGSKS GNTASLTISG
LQAEDEADYY CNSYTTSATL VFGGGTKLTV LSQPKAAP >LC-107-D01 (SEQ ID NO:1084)
AQSELTQPAS VSGPPGQSIT ISCTGTSSDV GGYNYVSWYQ
QHPGKAPKLI IYEVSNRPSG VSYRFSASKS DNTASLTISG
VQAEDEADYY CSSYKRGGTY VFGTGTTVIV LGQPKANP >LC-107-D05 (SEQ ID NO:1085)
AQDIQMTQSP STLSASVGDR VTITCRASQS ISSWLAWYQQ
KPGKVPKLLI HAASTLQSGV PSRFSGSGSG TDFTLTISSL
QPEDVATYYC QKYNSAPLTF GGGTKVEIKR TVAAP >LC-107-D12 (SEQ ID NO:1086)
AQYELTQPPS ASGTPGQRVT ISCSGSSSDI GSNTVNWYQQ
LPGTAPKLLI YSNNQRPSGV PDRFSGSKSG TSASLAISGL
QSEDEADYYC AAWDDSLNGY VFGTGTKVTV LGQPKANP >LC-107-F11 (SEQ ID NO:1087)
AQDIQMTQSP GTLSLSPGER ATLSCRASQS VSGSYLAWYQ
QKPGQAPSLL IYGAYSRATG IPDRFSGSGS GTDFTLTISR
LEPEDFAVYY CQHYCSSPRT FGGGTKVEIK RTVAAP >LC-108-C10 (SEQ ID NO:1088)
AQSVLTQPAS VSGSPGQSIT ISCTGTSSDV GGYNYVSWYQ
QHPGQPPKLI IYEVSNRASG VSNRFSGSKF GNTASLTISG
LQSEDEADYH CSSYTSSTTL LFGGGTRLTV LGQPKAAP >LC-108-D11 (SEQ ID NO:1089)
AQSVLTQPAS VSGSPGQSIT ISCTGTNTDV GGYNLVSWYQ
QHPGKAPKLI IYEVSNRPSG VSNRFSGSKS GNTASLTISG
LQAEDEVDYY CGSYTSSSTH VFGSGTKVTV LGQPKANP >LC-108-E10 (SEQ ID NO:1090)
AQDIQMTQSP GTLSLSPGER ATLSCRASQT VSSTYLAWYQ
QKPGQAPRLL TYGASSRATG IPDRFSGGGS GTDFTLTISR
LEPEDFAVYY CQQYGSSPPR YTFGQGTKLE IKRTVAAP >LC-108-E11 (SEQ ID NO:1091)
AQYELTQPAS VSGSPGQSIT ISCTATSSDL GSYNFVSWYQ
QHPDKAPKLM IFEVSRRPSG VSNRFSGSKS GNTASLTISG
LQAEDEADYY CCSYAGSNTY VFGTGTKVTV LGQPKANP >LC-109-A11 (SEQ ID NO:1092)
AQSELTQPAS VSGSPGQSIT ISCTGTSSDV GGYNYLSWYQ
QHPGKAPKLM IYGVSNRPSG VSTRFSGSKS GNTASLTISG
LQAEDEADYY CSSYTSTGTR VFGGGTRLTV LGQPKAAP >LC-109-E08 (SEQ ID NO:1093)
AQDIQMTQSP ATLSVSPGER ATLSCRASQS VSSNLAWYQQ
KPGQAPRLLI YGASTRATGI PARFSGSGSG TEFTLTISSL
QSEDFAVYYC QQNNWPPSF TFGPGTKVDI KRTVAAP
```

-continued

>LC-110-D06 (SEQ ID NO:1094)
AQDIQMTQSP STLSASLGDR VIITCRASQG IRSWLAWYQQ
KPGKAPKLLI YAASSLQSGV PSRFSGSGSG TDFTLTISSL
QPEDFATYYC QQSYSTPWTF GQGTKVEIKR TVAAP

>LC-110-D11 (SEQ ID NO:1095)
AQSELTQPAS VSGSPGQSIT ISCTGTSTDV GGYNYVSWYQ
KHPGKAPKLM IYDVSNRPSG VSNRFSGSKS GNTASLTISG
LQAEDEADYY CSSYTNTITV VFGGGTKLTV LGQPKAAP

>LC-110-F08 (SEQ ID NO:1096)
AQDIQMTQSP GTLSLSPGER ATLSCRASQS VVSNFLAWYQ
QKPGQAPRLL IYGASSRATG IPDRFSGSGS GTDFILTISR
LEPEDFAVYY CQQYGSSPYS FGQGTKLEIK RTVAAP

>LC-110-G01 (SEQ ID NO:1097)
AQYELTQPPS ASGTPGQRVT ISCSGSSSNI GSNTVNWYQQ
LPGTAPKLLI YSNNQRPSGV PDRFSGSKSG TSASLAISGL
QSEDEADYYC AAWDDSLNGY VFGTGTKVTV LGQPKANP

>LC-110-H11 (SEQ ID NO:1098)
AQDIQMTQSP SSLSASVGDR VTITCRASQS ISSYLNWYQQ
KPGKAPKLLI YAASSLQSGV PSRFSGSGSG TDFTLTISSL
HPEDFATYYC QQTYSTLFTF GPGTKVHIKR TVAAP

>LC-111-B02 (SEQ ID NO:1099)
AQYELTQDPA VSVALGQTVR ITCQGDSLRS YYASWYQQKP
GQAPVLVIYS KSNRPSGIPD RFSGSSSGST ASLTITGAQA
EDEADYYCNS RDSSGNHLVF GGGTKLTVLG QPKAAP

>LC-111-C10 (SEQ ID NO:1100)
AQDIQMTQSP SSLSASVGDR VTITCRASQS ISSYLNWYQQ
KPEKAPQLLI FAASSLQSGV PSRFSGSGSG TDFTLTISSL
QPEDFATYYC QQSYNAPWTF GQGTKVEIRR TVAAP

>LC-111-D11 (SEQ ID NO:1101)
AQDIQMTQSP ATLSLSPGDR ATLSCRASQR VSSTFLAWYQ
QRPGQAPRLV IFGTSSRATG IPDRFSGSGS GTDFTLTISR
LEPEDFAVYY CHQYGSSPRT FGQGTKVEIK RTVAAP

>LC-112-C02 (SEQ ID NO:1102)
AQDIQMTQSP GTLSLSPGDR ATLSCRASQS VSSNYLAWYQ
QKPGQAPRLL IYGASSRATG IPDRFSGSGS GTDFTLTISR
LEPEDFGVYY CQQFGSSLFT FGPGTKVNIK RTVAAP

>LC-112-C12 (SEQ ID NO:1103)
AQDIQMTQSP GTLSLSPGER ATLSCRASQS VSSSYLAWYQ
QKPGQAPRLL IYGASSRATG IPDRFSGSGS GTEFTLTISS
LQSEDSAVYY CQQYNNWPPL TFGGGTKVEI KRTVAAP

>LC-112-D04 (SEQ ID NO:1104)
AQSALTQPLS VSVALGQTAR ITCGGNNIGS KNVHWYQQKP
GQAPVLVIYR DSNRPSGIPE RFSGSNSGNT ATLTISGAQA
GDEADYYCQV WDSSTVFGGG TKLTVLGQPK AAP

>LC-112-D07 (SEQ ID NO:1105)
AQDIQMTQSP SSLSASVGDR VTITCRASQT IRTYLNWYQQ
KPGIAPKFLI YDASNLQTGV PSRFSGSGSG THFTLTISSL
QPEDFGTYYC QQSYGGPPTF GRGTKIEIKR TVAAP

>LC-113-D05 (SEQ ID NO:1106)
AQDIQMTQSP GTLSLSPGER ATLSCRASQS VSSSYLAWYQ
QKPGQAPRLL IYGASSRATG IPDRFSGSGS GTDFTLTISR
LEPEDFAVYY CQQYGSSSFT FGPGTKVDIK RTVAAP

>LC-113-E03 (SEQ ID NO:1107)
AQDIQMTQSP SSLSASVGDR VTITCRASQS INSYLNWYQQ
KPGKAPNLLI YAASSLQNGV PSRFSGSGSG TDFTLTISSL
QPEDFAAYYC QQSYSTPLTF GGGTKVEIKR TVAAP

>LC-113-G11 (SEQ ID NO:1108)
AQDIQMTQSP SSLSASVGDR VTITCRASQS ISSYLNWYQQ
KPGKAPKLLI YAASSLQSGV PSRFSGSGSG TDFTLTISSL
QPEDFATYYC QQSYSTLVTF GQGTKLEIKR TVAAP

>LC-114-D02 (SEQ ID NO:1109)
AQDIQMTQSP SSLSASVGDR VTITCRASQG ISNYLAWYQQ
KPGKVPKLLI YAASTLQSGV PSRFSGSGSG TDFTLTISSL
QPEDVATYYC QKYNSAPWTF GQGTKVEIKR TVAAP

>LC-114-E02 (SEQ ID NO:1110)
AQDIQMTQSP ATLSLSPGER ATLSCRASQS VGGYLAWYQQ
KPGQAPRLLI YDASKRATGI PARFSGSGSG TDFTLTISSL
EPEDFAVYYC QQRSKWPPYT FGQGTKLEIK RTVAAP

>LC-114-F04 (SEQ ID NO:1111)
AQSELTQPAS VSGSPGQSIA ISCTGTSSDI GAYPFVSWYQ
QHPGKAPKLM IYGVTTRPFG VSDRFSGSKS GSTASLTISG
LQAEDEADYY CSSYAGGRNL PYVFGTGTTV TVLGQPKANP

>LC-114-G06 (SEQ ID NO:1112)
AQDIQMTQSP SSLSASVGDR VTITCRASQG ISSWLAWYQQ
RPERAPKSLI YAASSLERGV PSRFRGSGSG TDFTLTISSL
QPEDFGTYYC QQYHNFPLTF GGGTRVEINR TVAAP

>LC-114-G09 (SEQ ID NO:1113)
AQSALTQPAS VSGSPGQSIT ISCTGTSSDV GSYKLVSWYQ
QHPGKAPKLM IYEGSKRPSG VSNRFSGSKS GNTASLTISG
LQAEDEADYY CCSYAGSSTW VFGGGTKLTV LGQPKAAP

>LC-114-H07 (SEQ ID NO:1114)
AQDIQMTQSP GTLSLSPGER ATLSCRASQS VSSSYLAWYQ
QKPGQAPRLL IYGASSRATG IPDRFSGSGS GTDFTLTISR
LEPEDFAVYY CQQYGSSPFT FGPGTKVDIK RTVAAP

>LC-115-F04 (SEQ ID NO:1115)
AQSALTQPPS VSVSPGQTVS ITCSGDDLGG RHVSWFQQLS
GQSPVLVIYQ DDKRPSGIPE RFSGSNSGNT ATLTISGTQS
VDEGDYYCLA WHNYKYVFGS GTTVTVLRQP KANP

>LC-115-F08 (SEQ ID NO:1116)
AQSELTQPAS VSGSPGQSIT ISCTGTSSDV GGYNYVSWYQ
QHPGKAPKLM IYEVSNRPSG VSNRFSGSKS GNTASLTISG
LQAEDEADYY CSSYTSSSTW VFGGGTKLTV LGQPKAAP

>LC-115-G12 (SEQ ID NO:1117)
AQDIQMTQSP VTLSLSPGER ATLSCRASQS VSFNLAWYQH
KPGQAPRLLM FDASNRATGI PDRFSGSGSG TDFTLTIKRL
EPEDFAVYYC QQYGTSPFTF GPGTNVDVKR TVAAP

>LC-116-A08 (SEQ ID NO:1118)
AQDIQMTQSP GTLSLSPGER ATLSCRASQS VSNSYLAWYQ
QRPGQAPRLL IYGASSRATG IPDRFSGSGS GTEFTLTISR
LEPEDFAVYY CQQFGSSTGY TFGQGTKLEL KRTVAAP

>LC-116-C09 (SEQ ID NO:1119)
AQSALTQPPS VSVSPGQTAS ITCFGDKLGD KYGSWYQQKP
GQSPVLVLYQ YWKRPSGIPE RFSGSNSGNT ATLTINVTQT
MDEADYYCQA WDSNTVVFGG GTKLTVLGQP KAAP

>LC-116-E08 (SEQ ID NO:1120)
AQDIQMTQSP SSLSASVGDR VTITCLASQS ISSYLNWYQQ
KPGKAPKLLI YDASSLESGV PSRFSGSGSG TDFTLTISSL
QPEDFAIYYC QQFNGYPPIT FGQGTRLEIK RTVAAP

>LC-117-A12 (SEQ ID NO:1121)
AQDIQMTQSP GTLSLSPGDR ATLSCRASQS VGSDYLAWYQ
QKPGQAPRLL IYGASSRATG IPDRFSGSGS GTDFTLTISR
LEPEDFAVYY CQQYGSSLYT FGQGTKLEIK RTVAAP

>LC-117-B07 (SEQ ID NO:1122)
AQDIQMTQSP ATLSLSPGER ATLSCRASQS VSSYLAWYQQ
KPGQAPRLLI YDASNRATGI PARFSGSGSG TDFTLTISSL
EPEDFAVYYC QQRSNFGGGT KVEIKRTVAA P

>L-117-C04 (SEQ ID NO:1123)
AQDIQMTQSP LSLSASVGDR VTITCRASQT FNNYLNWYQQ
KPGKAPKLLI YAASTLQSGV PSRFSGSGSG TDFTLTISSL
QPEDFATYYC QQANSFPFTF GPGTKVDIKR TVAAP

>LC-117-F04 (SEQ ID NO:1124)
AQDIQMTQSP SSLSASVGDR VTITCRASQG IGNYLAWYQQ
KPGKAPNLLI YKTSNLQSGV PSRFRGSGSG TEFTLTITSV
QPDDFATYFC QRYDSYSQYI FGQGTKLETK RTVAAP

>LC-117-F08 (SEQ ID NO:1125)
AQYELTQPPS VSVSPGQTAT ITCSGDKLEE KYVCWYQQKP
GQSPAVVIYQ DTKRPSGVPD RFSGSKSGTS ASLAISGLRS
EDEADYYCAT WDDSLSGPVF GGGTKLTVLG QPKAAP

-continued

>LC-118-E07 (SEQ ID NO:1126)
AQDIQMTQSP SSLSASVGDR VTITCRASQG ISNYLAWYQQ
KPGKVPKLLI YAASTLQSGV PSRFSGSGSG TDFTLTISSL
QPEDVATYYC QKYNSAPLTF GGGTKVEIKR TVAAP

>LC-119-B09 (SEQ ID NO:1127)
AQDIQMTQSP ATLSVSPGEG ATLSCRASQS VGNSLAWYQQ
KPGQAPRVLV YGASTRASGI PARFSGSGSV TEFTLTISSL
QSEDFAVYYC QEYNKWPITF GQGTRLERKR TVAAP

>LC-121-A07 (SEQ ID NO:1128)
AQDIQMTQSP GTLSLSPGER ATLSCRASQS VSSNYLAWYQ
QKPGQAPRLL MYGASYRATG IPDRFSGSGS GTDFTLTISS
LQPEDFATYY CQQSYSTPWT FGQGTKVEIK RTVAAP

>LC-121-H07 (SEQ ID NO:1129)
AQDIQMTQSP SSLSASVGDR VTITCRASQS ISRYLNWYQQ
KPGKAPKLLI YAASNLQSGV PSRFSGSGSG RDYTLTISSL
QPEDFVTYYC QQSYSTPWTF GQGTKVEIKR TVAAP

>LC-122-A05 (SEQ ID NO:1130)
AQDIQMTQSP SSFSASTGDR VTITCRASQS ISRWLAWYQQ
KPGKAPKLLI YEASTLESGV PSTFSGSGSG TEFTLTISSL
QPDDFATYYC QQYNSYPLTF GGGTKVEIKR TVAAP

>LC-122-D01 (SEQ ID NO:1131)
AQDIQMTQSP SSVSASVGDR VTITCRASQD IRTWLAWYQQ
KSGKAPKLLI YSSSSLQSGI SSRFSGSGSG TDFTLTISNL
QPEDSAIYYC QQATTFPWTF GGGTKVEIKR TVAAP

>LC-122-G06 (SEQ ID NO:1132)
AQSALTQPAS VSGSPGQSIT ISCTGTSSDV GGYNYVSWYQ
QHPGKAPKLM IYDVSKRPSG VSNRFSGSKS GNTASLTISG
LQAEDEADYY CSSYTSSITL VVFGGGTKLT VLSQPKAAP

>LC-122-H04 (SEQ ID NO:1133)
AQYELTQPRS VSGSPGQSVT ISCTGTSSDV GGFNYVSWYQ
QHPGKAPKLM IYDVSKRPSG VPDRFSGSKS GTTASLTISG
LQADDEADYY CCSYTGNYTY VFGTGTKVTV LGQPKANP

>LC-123-E02 (SEQ ID NO:1134)
AQSALTQPAS VSGSPGQSIT ISCSGTSSDV GAYYHVSWYQ
QHPGKAPKLM IYDVSNRPSG VSNRFSGSKS GNTASLTISG
LQAEDEADYY CSLYIGTSTP WVFGGGTKLT VLGQPKAAP

>LC-124-A01 (SEQ ID NO:1135)
AQDIQMTQSP SSLSASVGDR VTITCRASQS ITGYLNWYQQ
KPGKAPKLLI YAASSLQSGV PSRFSGSGSG TDFTLSISSL
QPEDFATYYC QQSYSTPYTF GQGTKLEIKR TVAAP

>LC-124-C04 (SEQ ID NO:1136)
AQDIQMTQSP SSLSASVGDR VTITCRASQT ISSYLNWYQQ
KPGKAPKLLI YAASSLQSGV PSRFSGGGSG TDFTLTISSL
QPEDFATYYC QQSYSTPMYT FGQGTKLYIK RTVAAP

>LC-124-C12 (SEQ ID NO:1137)
AQDIQMTQSP GTLSLSPGER ATLSCRASQS VSSNYLAWYQ
QKPGQAPKLL IYAASSLQSG VPSRFSGSGS GTDFTLTISS
LQPEDFATYY CQQRWTFGQG TKVEIKRTVA AP

>LC-124-G12 (SEQ ID NO:1138)
AQDIQMTQSP SSVSASVGDR VTITCRASQG ISSWLAWYQQ
KPGKAPKLLI YAASSLQSGV PSRFSGSGSG TDFTLTISSL
QPEDFATYYC QQANSFPLTF GGGTKVEIKR TVAAP

>LC-124-H10 (SEQ ID NO:1139)
AQDIQMTQSP ATLSLSAGER ATLSCRASQS VNIDVGWYQQ
KPGQAPRLLI YDASKRATGI PTRFSGSGSG TDFTLTIANL
EPEDFAVYYC QQRARWLTFG GGTRLEIKRT VAAP

>LC-125-C04 (SEQ ID NO:1140)
AQSELTQPAS VSGSPGQSIT ISCAGTSSDL GGYDYVSWYQ
QYPGKAPKLI IYQVGRRPSG VSNRFSGSKS GNTASLTISG
LQTEDEADYY CSSYTSSRTR VFGGGTRVTV LGQPKAAP

>LC-126-B12 (SEQ ID NO:1141)
AQDIQMTQSP GTLSLSPGER ATLSCRASQS VSSSYLAWYQ
QKPGQAPRLL IYGASSRATG IPDRFSGSGS GTDFTLTISR
LEPEDFAVYY CQQYGSSSYT FGQGTKLEIK RTVAAP

>LC-126-C10 (SEQ ID NO:1142)
AQDIQMTQSP SSLSASVGDR VTITCRAGQT INNYLNWYQQ
KPGKAPNLLI YAASNLQSGV PSRFSGSKSG TDFTLTISSL
QPEDFATYHC QQTYRTPFTF GGGTRVEIKG TVAAP

>LC-126-F11 (SEQ ID NO:1143)
AQDIQMTQSP STLSASVGDR VTITCRASQS ISSWLAWYQQ
KPGKAPKLLI YKASSLESGV PSRFSGSGSG TEFTLTISSL
QPDDFATYYC QQYNSYRYTF GQGTKLEIKR TVAAP

>LC-126-H09 (SEQ ID NO:1144)
AQSVLTQDPA VSVALGQTVR FTCQGDSLRN YHPSWYQQKP
RQAPVLVMFG RNNRPSGIPD RFSGSTSGGT ASLTITATQA
DDEADYFCSS RDGSGNFLFG GGTKLTVLGQ PKAAP

>LC-127-C06 (SEQ ID NO:1145)
AQDIQMTQSP STLSASVGDR VTITCRASQS ISSWLAWYQQ
KPGKAPKLLI YKASSLGSGV PSRFSGSGSG TEFTLTISSL
QPDDFATYYC QQYYSYSQTF GQGTKVEIKR TVAAP

>LC-127-D05 (SEQ ID NO:1146)
AQDIQMTQSP SSLSASVGDR VTITCRASQS ISSYLNWYQQ
KPGKAPKLLI YAASSLQSGV PSRFSGSGSG TDFTLTISSL
QPEDFATYYC QQSYSTPRTF GPGTKVDIKR TVAAP

>LC-127-H05 (SEQ ID NO:1147)
AQDIQMTQSP SSLSASVGDR VTITCRASQS ISSYLNWYQQ
KPGKVPKLLI YAASSLQSGV PSRFSGSGSG TDFTLTISSL
QPDDFATYYC QQTFSTWTFG QGTKVEIRRT VAAP

>LC-128-A06 (SEQ ID NO:1148)
AQSALTQPPS LSVSAGQTAT ITCSPGGGL RNKYVSWYQQ
RPGQSPFLVI YKDAERPSGI PERFSGSNFG NTATLTIGGT
QAMDEADFYC LAWDSTTRVF GGGTKLTVLS QPKAAP

>LC-128-E07 (SEQ ID NO:1149)
AQDIQMTQSP STLSASVGDR VTITCRASQS ISSWLAWYQQ
KPGKAPKLLI YKASSLESGV PSRFSGSGSG TEFTLTISSL
QPDDFATYYC QQYNSYPVTF GQGTKLEIKR TVAAP

>LC-128-F11 (SEQ ID NO:1150)
AQDIQMTQSP SSLSASVGDR VTITCRASQY TSTYLAWYQQ
KPGKAPKLLI YKASDLESGV PSRFSGSGSG TEFTLTINSL
QPDDFATYYC QQYNTYWTFG HGTKVEIKRT VAAP

>LC-129-B09 (SEQ ID NO:1151)
AQDIQMTQSP SFLSASVGDR VTITCRASQG ISSYLAWYQQ
KPGKAPKLLI YAASTLQSGV PSRFSGSGSG TEFTLTISSL
QPEDFATYYC QQLNSYPRTF GQGTKVEIKR TVAAP

>LC-130-B02 (SEQ ID NO:1152)
AQSALTQPAS VSGSPGQSIT ISCTDTSGNV GSYNLVSWYQ
QHPDKAPKLM IFEVSRRPSG VSDRFSGSKS GNTASLTISG
LQAEDEADYY CCSYAGSNTY VFGTGTKVTV LGQPKANP

>LC-131-A03 (SEQ ID NO:1153)
AQYELTQPAS VSGSPGQSIT ISCTGTNTDV GGYNYVSWYQ
QYPGKAPKLM IYEVNHRPSG VSNRFSGSKS GNTASLTISG
LQAEDEADYY CSSYTYRNTY VFGTGTKVTV LGQPKANP

>LC-131-B05 (SEQ ID NO:1154)
AQYELTQPAS VSGSPGQSIT ISCTGTSSDI GAYNYVSWYQ
QHPGKAPKLM IYDVSNRPSG VSNRFSGSKS GNTASLTISG
LQAEDEADYY CSSYRSSSLM FGGGTKLTVL GQPKAAP

>LC-131-C08 (SEQ ID NO:1155)
AQDIQMTQSP SSVSASVGDR VTITCRASQD VLVSFAWYQQ
RPGTAPKLLI YAASHLHPGV PSRFSASGSG TDFTLTINGL
QPEDFATYYC QQARSFPHTF GQGTRLEKKR TVAAP

>LC-131-C09 (SEQ ID NO:1156)
AQYELTQPPS ASGTPGQRVT ISCSGSSSNI GTNRVNWYQQ
IPGTAPKLLI YSNNQRPSGV PDRFSDSKSG TSASLAISGL
QSEDEADYYC AAWDDSLTGP VFGGGTKVTV LRQPKAAP

>LC-131-D01 (SEQ ID NO:1157)
AQDIQMTQSP GTLSLSPGER ASLSCRASQS VSSNYLSWYQ
QKPGQAPRLL IYGTSNRASG IPVRFSGSGS GTDFTLTISR
LEPEDFAVYY CQQYGGAPLF IFGPGTRVDI KRTVAAP

```
>LC-131-D12 (SEQ ID NO:1158)
AQSALTQPPS VSVAPGQTAS ISCSGNILDN SYASWFQQKP
GQSPVMVIHR DNKRPSGIPE RFSGSTSGNT ATLTISGTQA
VDEADYYCQA WDRTTGVFGT GTRLTVLRQP KAAP

>LC-131-F07 (SEQ ID NO:1159)
AQDIQMTQSP SSLSASVGDR VTITCRASQS ISSYLNWYQQ
KPGKAPKLLI YAASSLQSGV PSRFSGSGSG TDFTLTISSL
QPEDFATYYC QQSYSTPLTF GGGTKVEIKR TVAAP

>LC-131-F09 (SEQ ID NO:1160)
AQDIQMTQSP ATLSLSPGER ATLSCRASQS VSSYLAWYQQ
KPGQAPRLLI YDASNRATGI PARFSGSGSG TDFTLTISSL
EPEDFAVYYC QQRSNWLWTF GQGTKVEIKR TVAAP

>LC-131-F12 (SEQ ID NO:1161)
AQDIQMTQSP SSLSASVGDR VTITCRASQS ISSYLNWYQQ
KPGKAPKLLI YAASSLQSGV PSRFSGSGSG TDFTLTISSL
QPEDFATYYC QQSYSTPRTF GGGTKVEIKR TVAAP

>LC-131-G06 (SEQ ID NO:1162)
AQYELTQAPS ASGTPGQRVT ISCSGSRSNI GTNPVNWYQH
VPGTAPKLLI LVNNQRPSGV PDRFSGSKSG ASASLAISGL
QSEDEAEYYC ATWDGSLNGP VFGGGTKLTV LRQPKAAP

>LC-132-C01 (SEQ ID NO:1163)
AQSALTQPRS VSGSPGQSVT ISCTGTGSNI DGYNYVSWYQ
QYPGNAPKLI IYDVGKRPSG VPNRFSGSKS GNTASLTISG
LQAEDEADYY CCSYAGSYSY VFGVGTKVTV LGQPKANP

>LC-132-C08 (SEQ ID NO:1164)
AQDIQMTQSP SSLSASVGDR VTITCRASQS ISSYLNWYQQ
KPGKAPKLLI YAASSLQSGV PSRFSGSGSG TDFTLTISSL
QPEDFATYYC QQSYSTPRTF GGGTKLEIKR TVAAP

>LC-132-D02 (SEQ ID NO:1165)
AQSALTQPRS VSGSPGQSVT ISCTGTSSDV NYVSWYQQHP
GKAPKLMIYA VTKRPSGVPD RFSGSKSGNT ASLTVSGLQA
EDEADYYCSS YAGSNNLVFG GGTKLTVLGQ PKAAP

>LC-132-D08 (SEQ ID NO:1166)
AQDIQMTQSP STLSASVGDR VTITCRASQS ISNWLAWYQQ
KPGKAPKLLI YMASTLESGV PSRFSGSGSG TEFTLTISSL
QPADFATYYC QQYNSYSVTF GGGTKVEIKR TVAAP

>LC-132-H11 (SEQ ID NO:1167)
AQYELTQPPS ASGTPGQRVT ISCSGSSSNI GSNYVYWYQQ
LPGTAPKLLI YRNNQRPSGV PDRFSGSKSG TSASLAISGL
RSEDEADYYC AAWDDSLSGH AVFGGGTQLT VLGQPKAAP

>LC-133-E02 (SEQ ID NO:1168)
AQSVLTQPPS ASGTPGQRVT VSCSGSSSNI GSNIVSWYRQ
LPGTAPKLLI YSNNRRPSGV PDRFSGSKSG TSASLAISGL
QSEDEADYYC AAWDDSLNGH VFGGGTKLTV LRQPKAAP

>LC-138-G11 (SEQ ID NO:1168)
LC-133-E02 is same as LC-138-G11
AQSVLTQPPS ASGTPGQRVT VSCSGSSSNI GSNIVSWYRQ
LPGTAPKLLI YSNNRPSGV PDRFSGSKSG TSASLAISGL
QSEDEADYYC AAWDDSLNGH VFGGGTKLTV LRQPKAAP >LC-134-B03 (SEQ ID NO:1169)
AQSALTQPPS ASGSPGQSVT ISCTGTSSDV GAYNYVSWYQ
QHPGKAPKLI IYEVNKRPSG VPDRFSASKS GNTASLTVSG
LQAEDEADYY CNSYAGSNSL IFGGGTKLTV LGQPKAAP >LC-134-D07 (SEQ ID NO:1170)
AQDIQMTQSP SSLSASVGDR VTITCRASQG IRNDLGWYQQ
KPGKAPKLLI YAASSLQSGV PSRFSGSGSG TDFTLTISSL
QPEDFATYYC LQDYNYPRTF GQGTKVEIKR TVAAP >LC-135-B05 (SEQ ID NO:1171)
AQDIQMTQSP SSLSASVGDR VTITCRASQS ISTYLNWYQQ
KPGKAPNLLI YAASSLQSGV PSRFSGSGSG TDFTLTVSSL
QPEDFGTYYC QQYNSFPFSF GGGTRLEINR TVAAP >LC-135-C11 (SEQ ID NO:1172)
AQDIQMTQSP SSVSASVGDR VTITCRASQG ISSWLAWYQQ
KPGKAPKLLI YAASSLQSGV PSRFSGSGSG TDFTLTISSL
QPEDFATYYC QQANSFPSLT FGGGTKVEIK RTVAAP >LC-135-C12 (SEQ ID NO:1173)
AQSELTQPPS MSGTPGQRVI ISCSGSNSNI GNNFVYWYQQ
VAGSAPKLLI FRNNQRPSGV PDRFTVSKSG ASASLAIGGL
RSEDEADYYC AAWDDSLSGV LFGGGTKVTV LGQPKAAP >LC-135-E10 (SEQ ID NO:1174)
AQDIQMTQSP SSLSASVGDR VTITCRASQS ISSYLNWYQQ
KPGKAPKLLI YAASSLQSGV PSRFSGSGSG TDFTLTISSL
QPEDFATYYC QQSYSTLYTF GQGTKLEIKR TVAAP >LC-135-F03 (SEQ ID NO:1175)
AQDIQMTQSP ATLSLSPGER ATLSCRASQS VSSYLAWYQQ
KPGQAPRLLI YDASNRATGI PARFSGSGSG TDFTLTISSL
EPEDFAVYYC QQRSNWPSPI AFGQGTRLEI KRTVAAP >LC-136-A07 (SEQ ID NO:1176)
AQSVLTQPPS ASGTPGQRVT ISCSGGSSNI GSNRVNWYQQ
VPGTAPKLLI DSNNQRPSGV PDRFSGSKSG TSASLAISGL
QSEDEAGYYC AAWDDNLIGP VFGGGTKLTV LGQPKAAP >LC-136-B06 (SEQ ID NO:1177)
AQDIQMTQSP SSLSASVGDR VTITCRASQS ISSYLNWYQQ
KPGKAPKLLI YAASSLQSGV PSRFSGSGSG TDFTLTISSL
QPEDFATYYC QQSYSTPWTF GQGTKVEIKR TVAAP >LC-136-D07 (SEQ ID NO:1178)
AQDIQMTQSP SSVSASVGDR VTITCRASQD IASWLAWYQQ
KPEKVPKLLI YAASSLQSGV PSRFSGSGSG TDFTLTINSL
QPEDFATYYC QQANSFPFTF GPGTKVDFKR TVAAP >LC-136-E10 (SEQ ID NO:1179)
AQDIQMTQSP GTLSLSPGER ATLSCRASQS VTTFLAWYQR
KPGQAPRLLI YGASSRAADI PDRFSGSGSG TDFTLTISRL
EPEDLAVYYC QQYRFSPPTF GPGTTVDIRR TVAAP >LC-136-E12 (SEQ ID NQ:1180)
AQDIQMTQSP SSLSASVGDR VTITCRASHV INIDLGWYQQ
KPGKAPKLLI YGASHLQRGV PSRFSGSGSG TVFTLTISGL
QPEDFATYYC LQDSFYPRTF GQGTRLEIKR TVAAP >LC-136-F08 (SEQ ID NO:1181)
AQDIQMTQSP GTLSLSPGER ATLSCRASQS VSSSYLAWYQ
QKPGqAPRLL IYDASNRATG IPARFSGSGS GTDFTLTISS
LEPEDFAVYY CQQWDTFGQG TKLEIKRTVA AP >LC-137-B01 (SEQ ID NO:1182)
AQDIQMTQSP GTLSLSPGER ATLSCRASQS VSSSYLAWYQ
QKPGQAPRLL IYGASSRATG IPDRFSGSGS GTDFTLTISR
LEPEDFAVYY CQQYGSSGWT FGQGTKVEIK RTVAAP >LC-137-E01 (SEQ ID NO:1183)
AQSELTQPPS ASGTPGQRVT ISCSGTNSNI GSNSVFWYQQ
LSGTAAPKVL ILRNSQRPSG VSDRFSGSKS GTSASLAISG
LRSEDEADYY CATWDDSLRS PVFGGGTKLT VLGQPKAAP >LC-137-G10 (SEQ ID NO:1184)
AQDIQMTQSP SSLSASVGDR VTITCRTSQT VSTFLNWYQQ
KPGTAPKLLI YAASRLQSGV PSRFSGSGSE TDFTLTISRL
QPEDFATYYC QQSFTSPRTF GLGTKVEIKR TVAAP >LC-138-A03 (SEQ ID NO:1185)
AQDIQMTQSP SSVSASVGDR VTITCRASQG ISSWLAWYQQ
KPGKAPKLLI YAASSLQSGV PSRFSGSGSG TDFTLTISSL
QPEDFATYYC QQANSFPHTF GQGTKLEIKR TVAAP >LC-138-B04 (SEQ ID NO:1186)
AQDIQMTQSP SSLSASVGDR VAITCRASQS IDTYLNWYQQ
KPGKAPKLLI YAASKLEDGV PSRFSGSGTG TDFTLTIRSL
QPEDFASYFC QQSYSSPGIT FGPGTKVEIK RTVAAP >LC-138-B06 (SEQ ID NO:1187)
AQDIQMTQSP SSVSASVGDR VTITCHASQG ISSWLAWYQQ
KPGKAPKLLI YAASSLQSGV PSRFSGSGSG TDFTLTISSL
QPEDFATYYC QQANSFPLTF GGGTKVEIKR TVAAP
```

```
>LC-138-B10 (SEQ ID NO:1188)
AQDIQMTQSP GTLSLSPGER ATLSCRASQS VSSSYLAWYQ
QKPGQAPRLL IYGASSRATG IPDRFSGSGS GTDFTLTISR
LEPEDFAVYY CQQYGSSLTF GQGTRLEIKR TVAAP

>LC-138-C04 (SEQ ID NO:1189)
AQYELTQPAS VSGSPGQSIT ISCTGTSSDV GAYNYVSWYQ
HHPGKAPKLL IYDVSNRPSG ISSRFSGSKS GNTASLTISG
LQAEDEADYY CSSYTSSYTW VFGGGTKLTV LSQPKAAP

>LC-138-C09 (SEQ ID NO:1190)
AQSELTQPAS VAGSPGQSIT ISCTGTSSDV GLYNFVSWYQ
QHPGKAPKLM IYDVSRRPSG VSNRFSASKS GTRASLTVSG
LQAEDEADYY CSSYAGSNNY VFGTGTKVTV LGQPKANP

>LC-138-E02 (SEQ ID NO:1191)
AQDIQMTQSP SSVSASVGDR VTITCRASQG ISSWLVWYQQ
KPGKAPKLLI YAASSLQSGV PSRFSGSGSG TDFTLTISSL
QPEDFATYYC QQAKTFPLTF GGGTKVEIKR TVAAP

>LC-138-E12 (SEQ ID NO:1192)
AQSALTQPAS VSGSPGQSIT ISCSGTSSDV GAYYHVSWYQ
QHPGKAPKLM IYEVTNRPSG ISNRFSGSKS GNTASLTISG
LQADDEADYF CSSYTTSNTL VFGGGTKVTV LGQPKAAP

>LC-139-A04 (SEQ ID NO:1193)
AQDIQMTQSP GTLSLSPGDR ATLSCRASQS VSSSYLAWYQ
QKAGQAPRLL IYGAASRATG IPDRFSGSGS GTDFTLTISR
LEREDFAVYY CQQYGSSPLI TFGQGTRLEI KRTVAAP

>LC-139-A09 (SEQ ID NO:1194)
AQDIVMTQTP PSLPVNPGEP ASISCRSSQS LVYSDGNTYL
NWFQQRPGQS PRRLIYKVSN RDSGVPDRFS GSGSGTDFTL
KISRVEAEDV GVYYCMQGTH WQRLTFGGGT KVEIKRTVAA P

>LC-139-C02 (SEQ ID NO:1195)
AQDIQMTQSP SSLSASVGDR VTITCRASQG IRRALAWYQQ
KPGKPPKLLI NDASSLESGV PSRFSGSGSG TDFTLTISSL
QPEDFATYYC QQSYSTPPWT FGQGTKVEIK RTVAAP

>LC-139-E12 (SEQ ID NO:1196)
AQDIQMTQSP SSVSASVGDR VTMTCRASRG ISNWLAWYQQ
KPGKAPELLI HSASTLHAGV PSRFSGSGSG TDFTLTISSL
QPGDFATYYC QEGNSFPYTF GQGTNLQIKR TVAAP

>LC-139-F04 (SEQ ID NO:1197)
AQDIQMTQSP SSLSASVGDR VTITCRASQA ISTNLNWYQQ
KPGKAPKLLI YAASSLQSGV PSRFIGSGSG TDFTLTISSL
HPEDFATYHC QQTFSPPHTF GQGTKVEIQR TVAAP

>LC-139-F09 (SEQ ID NQ:1198)
AQDIQMTQSP GTLSLSPGER ATLSCRASQS VSSSYLAWYQ
QKPGQAPRLL IYGASSRATG IPDRFSGSGS GTDFTLTISS
LQLEDFGTYF CQQSYRSPYT FGQGTKVDIK RTVAAP

>LC-135-H01 (SEQ ID NO:148
AQSVLTQPPS ASGTPGQRVT ISCSGSSSNI GSNYVYWYQQ
LPGTAPKLLI YRNNQRPSGV PDRFSGSKSG TSASLAISGL
RSEDEADYYC AAWDDSLSGV VFGGGTKLTV LGQPKAAP
```

The above-mentioned light chains variable domains are from the following light chain variable classes:

| LC-092-B12 | Kappa  | A20 |
|------------|--------|-----|
| LC-092-F08 | Kappa  | A11 |
| LC-092-G06 | Lambda | 2e  |
| LC-093-C02 | Kappa  | A27 |
| LC-093-C08 | Kappa  | A27 |
| LC-093-C10 | Kappa  | A20 |
| LC-093-E11 | Kappa  | L6  |
| LC-093-F09 | Lambda | 2a2 |
| LC-093-G06 | Lambda | 2e  |
| LC-093-G09 | Kappa  | O12 |
| LC-094-D08 | Lambda | 1c  |
| LC-094-E08 | Lambda | 2a2 |
| LC-094-F03 | Kappa  | A27 |
| LC-095-A11 | Kappa  | L6  |
| LC-095-G09 | Kappa  | L12 |
| LC-095-H10 | Kappa  | L12 |
| LC-096-D03 | Lambda | 2e  |
| LC-096-D09 | Lambda | 1c  |
| LC-096-E11 | Kappa  | O12 |
| LC-097-D04 | Lambda | 1g  |
| LC-097-E07 | Kappa  | O12 |
| LC-097-F03 | Kappa  | L2  |
| LC-097-F04 | Lambda | 1g  |
| LC-097-F08 | Kappa  | O12 |
| LC-097-G01 | Kappa  | A20 |
| LC-097-G07 | Kappa  | O12 |
| LC-098-C10 | Kappa  | O12 |
| LC-098-E01 | Kappa  | A27 |
| LC-098-E09 | Kappa  | L19 |
| LC-098-G05 | Kappa  | O12 |
| LC-098-H04 | Lambda | 2c  |
| LC-099-A09 | Kappa  | A27 |
| LC-099-C12 | Lambda | 2a2 |
| LC-099-D05 | Kappa  | A27 |
| LC-099-E11 | Kappa  | L12 |
| LC-101-E01 | Kappa  | L5  |
| LC-102-A04 | Lambda | 1g  |
| LC-102-C02 | Kappa  | A20 |
| LC-102-C12 | Kappa  | A20 |
| LC-102-D07 | Kappa  | A27 |
| LC-102-E09 | Kappa  | L6  |
| LC-102-G11 | Kappa  | A27 |
| LC-102-G12 | Lambda | 1c  |
| LC-102-H02 | Kappa  | L6  |
| LC-102-H11 | Kappa  | L6  |
| LC-103-A01 | Lambda | 1g  |
| LC-103-A03 | Kappa  | L5  |
| LC-103-E09 | Lambda | 2a2 |
| LC-103-F07 | Lambda | 2a2 |
| LC-103-H07 | Kappa  | O12 |
| LC-104-A12 | Kappa  | O12 |
| LC-104-B03 | Kappa  | A27 |
| LC-104-B12 | Kappa  | A20 |
| LC-104-D12 | Kappa  | O12 |
| LC-104-H12 | Lambda | 2c  |
| LC-105-B06 | Kappa  | O12 |
| LC-105-F02 | Kappa  | L11 |
| LC-106-C06 | Kappa  | L12 |
| LC-106-D06 | Kappa  | L5  |
| LC-106-E12 | Kappa  | A27 |
| LC-106-G12 | Kappa  | O12 |
| LC-107-B05 | Lambda | 2a2 |
| LC-107-D01 | Lambda | 2a2 |
| LC-107-D05 | Kappa  | A20 |
| LC-107-D12 | Lambda | 1c  |
| LC-107-F11 | Kappa  | A27 |
| LC-108-C10 | Lambda | 2a2 |
| LC-108-D11 | Lambda | 2a2 |
| LC-108-E10 | Kappa  | A27 |
| LC-108-E11 | Lambda | 2b2 |
| LC-109-A11 | Lambda | 2a2 |
| LC-109-E08 | Kappa  | L2  |
| LC-110-D06 | Kappa  | O12 |
| LC-110-D11 | Lambda | 2a2 |
| LC-110-F08 | Kappa  | A27 |
| LC-110-G01 | Lambda | 1c  |
| LC-110-H11 | Kappa  | O12 |
| LC-111-B02 | Lambda | 3l  |
| LC-111-C10 | Kappa  | O12 |
| LC-111-D11 | Kappa  | A27 |
| LC-112-C02 | Kappa  | A27 |
| LC-112-C12 | Kappa  | L16 |
| LC-112-D04 | Lambda | 3j  |
| LC-112-D07 | Kappa  | O12 |
| LC-113-D05 | Kappa  | A27 |
| LC-113-E03 | Kappa  | O12 |
| LC-113-G11 | Kappa  | O12 |
| LC-114-D02 | Kappa  | A20 |
| LC-114-E02 | Kappa  | L6  |
| LC-114-F04 | Lambda | 2a2 |
| LC-114-G06 | Kappa  | L15 |
| LC-114-G09 | Lambda | 2b2 |

-continued

| | | |
|---|---|---|
| LC-114-H07 | Kappa | A27 |
| LC-115-F04 | Lambda | 3r |
| LC-115-F08 | Lambda | 2a2 |
| LC-115-G12 | Kappa | A27 |
| LC-116-A08 | Kappa | A27 |
| LC-116-C09 | Lambda | 3r |
| LC-116-E08 | Kappa | L5 |
| LC-117-A12 | Kappa | A27 |
| LC-117-B07 | Kappa | L6 |
| LC-117-C04 | Kappa | O12 |
| LC-117-F04 | Kappa | L12 |
| LC-117-F08 | Lambda | 1g |
| LC-118-E07 | Kappa | A20 |
| LC-119-B09 | Kappa | L2 |
| LC-121-A07 | Kappa | L16 |
| LC-121-H07 | Kappa | O12 |
| LC-122-A05 | Kappa | L12 |
| LC-122-D01 | Kappa | L19 |
| LC-122-G06 | Lambda | 2a2 |
| LC-122-H04 | Lambda | 2e |
| LC-123-E02 | Lambda | 2a2 |
| LC-124-A01 | Kappa | O12 |
| LC-124-C04 | Kappa | O12 |
| LC-124-C12 | Kappa | O12 |
| LC-124-G12 | Kappa | L5 |
| LC-124-H10 | Kappa | L6 |
| LC-125-C04 | Lambda | 2a2 |
| LC-126-B12 | Kappa | A27 |
| LC-126-C10 | Kappa | O12 |
| LC-126-F11 | Kappa | L12 |
| LC-126-H09 | Lambda | 3l |
| LC-127-C06 | Kappa | L12 |
| LC-127-D05 | Kappa | O12 |
| LC-127-H05 | Kappa | O12 |
| LC-128-A06 | Lambda | 3r |
| LC-128-E07 | Kappa | L12 |
| LC-128-F11 | Kappa | L12 |
| LC-129-B09 | Kappa | L8 |
| LC-130-B02 | Lambda | 2b2 |
| LC-131-A03 | Lambda | 2a2 |
| LC-131-B05 | Lambda | 2a2 |
| LC-131-C08 | Kappa | L5 |
| LC-131-C09 | Lambda | 1c |
| LC-131-D01 | Kappa | A27 |
| LC-131-D12 | Lambda | 3r |
| LC-131-F07 | Kappa | O12 |
| LC-131-F09 | Kappa | L6 |
| LC-131-F12 | Kappa | O12 |
| LC-131-G03 | Lambda | 2c, same as LC-098-H04 |
| LC-131-G06 | Lambda | 1c |
| LC-132-C01 | Lambda | 2e |
| LC-132-C08 | Kappa | O12 |
| LC-132-D02 | Lambda | 2c |
| LC-132-D08 | Kappa | L12 |
| LC-132-H11 | Lambda | 1g |
| LC-133-E02 | Lambda | 1c |
| LC-133-E08 | Lambda | 1c, Same as LC-102-G12 |
| LC-134-B03 | Lambda | 2c |
| LC-134-D07 | Kappa | L11 |
| LC-135-B05 | Kappa | O12 |
| LC-135-C11 | Kappa | L5 |
| LC-135-C12 | Lambda | 1g |
| LC-135-E10 | Kappa | O12 |
| LC-135-F03 | Kappa | L6 |
| LC-136-A07 | Lambda | 1c |
| LC-136-B06 | Kappa | O12 |
| LC-136-D07 | Kappa | L5 |
| LC-136-E10 | Kappa | A27 |
| LC-136-E12 | Kappa | L11 |
| LC-136-F08 | Kappa | L6 |
| LC-137-B01 | Kappa | A27 |
| LC-137-E01 | Lambda | 1g |
| LC-137-G10 | Kappa | O12 |
| LC-138-A03 | Kappa | L5 |
| LC-138-B04 | Kappa | O12 |
| LC-138-B06 | Kappa | L5 |
| LC-138-B10 | Kappa | A27 |
| LC-138-C04 | Lambda | 2a2 |
| LC-138-C09 | Lambda | 2a2 |

-continued

| | | |
|---|---|---|
| LC-138-E02 | Kappa | L5 |
| LC-138-E12 | Lambda | 2a2 |
| LC-138-G11 | Lambda | 1c, Same as LC-133-E02 |
| LC-139-A04 | Kappa | A27 |
| LC-139-A09 | Kappa | A17 |
| LC-139-C02 | Kappa | L4 |
| LC-139-E12 | Kappa | L5 |
| LC-139-F04 | Kappa | O12 |
| LC-139-F09 | Kappa | A27 |

The following are amino acids sequences of exemplary heavy-chain variable regions.

```
>HC-092-B12 (SEQ ID NO:1199)
EVQLLESGGG LVQPGGSLRL SCAASGFTFS QYLMAWVRQA
PGKGLEWVSS IYPSGGNTNY ADSVKGRFTI SRDNSKNTLY
LQMNSLRAED TAVYYCARDR SIVPYSSSWY MPRDYYYGMD
VWGQGTTVTV SSASTKGPSV FPLAP

>HC-092-F08 (SEQ ID NO:1200)
EVQLLESGGG LVQPGGSLRL SCAASGFTFS HYPMIWVRQA
PGKGLEWVSG IYSSGGTTKY ADSVKGRFTI SRDNSKNTLY
LQMNSLRAED TAVYYCARVG VWYGMDVWGQ GTTVTVSSAS
TKGPSVFPLA P

>HC-092-G06 (SEQ ID NO:1201)
EVQLLESGGG LVQPGGSLRL SCAASGFTFS HYGMNWVRQA
PGKGLEWVSS IWSSGGYTTY ADSVKGRFTI SRDNSKNTLY
LQMNSLRAED TAVYYCARVG IWYSMDVWGQ GTTVTVSSAS
TKGPSVFPLA P

>HC-093-C02 (SEQ ID NO:1202)
EVQLLESGGG LVQPGGSLRL SCAASGFTFS WYAMHWVRQA
PGKGLEWVSW ISPSGGQTKY ADSVKGRFTI SRDNSKNTLY
LQMNSLRAED TAVYYCARAK VLRYFDWLLG GDAFDIWGQG
TMVTVSSAST KGPSVFPLAP

>HC-093-C08 (SEQ ID NO:1203)
EVQLLESGGG LVQPGGSLRL SCAASGFTFS RYPMGWVRQA
PGKGLEWVSS IYPSGGSTYY ADSVKGRFTI SRDNSKNTLY
LQMNSLRAED TAVYYCARVG VWYGMDVWGQ GTTVTVSSAS
TKGPSVFPLA P

>HC-093-C10 (SEQ ID NO:1204)
EVQLLESGGG LVQPGGSLRL SCAASGFTFS RYTMEWVRQA
PGKGLEWVSV IRPSGGTTMY ADSVKGRFTI SRDNSKNTLY
LQMNSLRAED MAVYYCARVG VWYGMDVWGQ GTTVTVSSAS
TKGPSVFPLA P

>HC-093-E11 (SEQ ID NO:1205)
EVQLLESGGG LVQPGGSLRL SCAASGFTFS HYEMAWVRQA
HGKGLEWVSV IYPSGGATRY ADSVKGRFTI SRDNSKNTLY
LQMNSLRAED TAVYYCARVA QYYGMDVWGQ GTTVTVSSAS
TKGPSVFPLA P

>HC-093-F09 (SEQ ID NO:1206)
EVQLLESGGG LVQPGGSLRL SCAASGFTFS DYRMWWVRQA
PGKGLEWVSY IVPSGGQTSY ADSVKGRFTI SRDNSKNTLY
LQMNSLRAED TAVYYCARGS AYQRRTYSSG WYSASGRRGT
AEYFQHWGQG TLVTVSSAST KGPSVFPLAP

>HC-093-G06 (SEQ ID NO:1207)
EVQLLESGGG LVQPGGSLRL SCAASGFTFS NYHMDWVRQA
PGKGLEWVSV IGPSGGFTRY ADSVKGRFTI SRDNSKNTLY
LQMNSLRAED TAVYYCARAL GGSLDYWGQG TLVTVSSAST
KGPSVFPLAP

>HC-093-G09 (SEQ ID NO:1208)
EVQLLESGGG LVQPGGSLRL SCAASGFTFS WYSMTWVRQA
PGKGLEWVSS ISPSGGATKY ADSVKGRFTI SRDNSKNTLY
LQMNSLRAED TAVYYCARGG AASLPFDYWG QGTLVTVSSA
STKGPSVFPL AP

>HC-094-D08 (SEQ ID NO:1209)
EVQLLESGGG LVQPGGSLRL SCAASGFTFS HYLMVWVRQA
PGKGLEWVSG IVPSGGYTMY ADSVKGRFTI SRDNSKNTLY
```

-continued
LQMNSLRAED TAVYYCTRAS YSSFGLDYWG QGTLVTVSSA
STKGPSVFPL AP

>HC-094-E08 (SEQ ID NO:1210)
EVQLLESGGG LVQPGGSLRL SCAASGFTFS FYAMVWVRQA
PGKGLEWVSY ISPSGGATWY ADSVKGRFTI SRDNSKNTLY
LQMNSLRAED TAVYYCAKPS RPRYYYDSSG YYSSAFDIWG
QGTMVTVSSA STKGPSVFPL AP

>HC-094-F03 (SEQ ID NO:1211)
EVQLLESGGG LVQPGGSLRL SCAASGFTFS WYQMSWVRQA
PGKGLEWVSS IYPSGGATKY ADSVKGRFTI SRDNSKNTLY
LQMNSLRAED TAMYYCARMG LHHSFDYWGQ GTLVTVSSAS
TKGPSVFPLA P

>HC-095-A11 (SEQ ID NO:1212)
EVQLLESGGG LVQPGGSLRL SCAASGFTFS PYMMGWVRQA
PGKGLEWVSS IRSSGGATAY ADSVKGRFTI SRDNSKNTLY
LQMNSLRAED TATYYCARVG VWYGMDVWGQ GTTVTVSSAS
TKGPSVFPLA P

>HC-095-G09 (SEQ ID NO:1213)
EVQLLESGGG LVQPGGSLRL SCAASGFTFS NYNMHWVRQA
PGKGLEWVSV IYPSGGYTVY ADSVKGRFTI SRDNSKNTLY
LQMNSLRAED TAVYYCARRG NWGGIDYWGQ GTLVTVSSAS
TKGPSVFPLA P

>HC-095-H10 (SEQ ID NO:1214)
EVQLLESGGG LVQPGGSLRL SCAASGFTFS NYKMQWVRQA
PGKGLEWVSS IYSSGGKTVY ADSVKGRFTI SRDNSKNTLY
LQMNSLRAED TAVYYCARTP GYNYFDYWGQ GTLVTVSSAS
TKGPSVFPLA P

>HC-096-D03 (SEQ ID NO:1215)
EVQLLESGGG LVQPGGSLRL SCAASGFTFS HYWMVWVRQA
PGKGLEWVSW IGPSGGGTVY ADSVKGRFTI SRDNSKNTLY
LQMNSLRAED TAVYYCARGN GGFDSWGRGT LVTVSSASTK
GPSVFPLAP

>HC-096-D09 (SEQ ID NO:1216)
EVQLLESGGG LVQPGGSLRL SCAASGFTFS WYHMYWVRQA
PGKGLEWVSY IRPSGGNTNY ADSVKGRFTI SRDNSKNTLY
LQMNSLRAED TAMYYCARDR RGYSSSKGYY YYGMDVWGQG
TTVTVSSAST KGPSVFPLAP

>HC-096-E11 (SEQ ID NO:1217)
EVQLLESGGG LVQPGGSLRL SCAASGFTFS HYLMYWVRQA
PGKGLEWVSS IYPSGGFTAY ADSVKGRFTI SRDNSKNTLY
LQMNSLRAED TAVYYCARRG VYGTFDIWGQ GTMVTVSSAS
TKGPSVFPLA P

>HC-097-D04 (SEQ ID NO:1218)
EVQLLESGGG LVQPGGSLRL SCAASGFTFS HYFMHWVRQA
PGKGLEWVSY ISSSGGLTGY ADSVKGRFTI SRDNSKNTLY
LQMNSLRAED TAVYYCARRG PVYYYDSSGS HSAFDIWGQG
TMVTVSKRLH QQPIGLPAST LLQEH

>HC-097-E07 (SEQ ID NO:1219)
EVQLLESGGG LVQPGGSLRL SCAASGFTFS WYQMMWVRKA
PGKGLEWVSY IRSSGGKTDY ADSVKGRFTI SRDNSKNTLY
LQMNSLRAED TAVYYCARVG VWYGMDVWGQ GTTVTVSSAS
TKGPSVFPLA P

>HC-097-F03 (SEQ ID NO:1220)
EVQLLESGGG LVQPGGSLRL SCAASGFTFS NYLMYWVRQA
PGKGLEWVSS IRPSGGNTLY ADSVKGRFTI SRDNSKNTLY
LQMNSLRAED TAVYYCARGR GILTGYYWGY YYYMDVWGKG
TTVTVSSAST KGPSVFPLAP

>HC-097-F04 (SEQ ID NO:1221)
EVQLLESGGG LVQPGGSLRL SCAASGFTFS PYQMWWVRQA
PGKGLEWVSS ISSSGGLTRY ADSVKGRFTI SRDNSKNTLY
LQMNSLRAED MAVYYCARVK LNYYGSGSYS LDAFDIWGQG
TNGHRLKRLH QGPIGLPAST LLQEH

>HC-097-F08 (SEQ ID NO:1222)
EVQLLESGGG LVQPGGSLRL SCAASGFTFS NYPMVWVRQA
PGKGLEWVSV IGPSGGKTKY ADSVKGRFTI SRDNSKNTLY
LQMNSLRAED TAVYYCARVG VWYGMDVWGQ GTTVTVSSAS
TKGPSVFPLA P

-continued

>HC-097-G01 (SEQ ID NO:1223)
EVQLLESGGG LVQPGGSLRL SCAASGFTFS PYYMQWVRQA
PGKGLEWVSG ISSSGGSTQY ADSVKGRFTI SRDNSKNTLY
LQMNSLRAED TAVYYCARSQ RRTYYPNFGD AFDIWGQGTM
VTVSSASTKG PSVFPLAP

>HC-097-G07 (SEQ ID NO:1224)
EVQLLESGGG LVQPGGSLRL SCAASGFTFS KYKMGWVRQA
PGKGLEWVSY IRPSGGMTFY ADSVKGRFTI SRDNSKNTLY
LQMNSLRAED TAVYYCREH YQASYSSSAW FRMVPAGAFD
IWGQGTMVTV SSASTKGPSV FPLAP

>HC-098-C10 (SEQ ID NO:1225)
EVQLLESGGG LVQPGGSLRL SCAASGFTFS FYSMMWVRQA
PGKGLEWVSG ISSSGGTTKY ADSVKGRFTI SRDNSKNTLY
LQMNSLRAED TAVYYCARGG TNYDYVWGSY RSHYYYYGMD
VWGQGTTVTV SSASTKGPSV FPLAP

>HC-098-E01 (SEQ ID NO:1226)
EVQLLESGGG LVQPGCSLRL SCAASGFTFS MYGMTWVRQA
PGKGLEWVSG ISPSGGRTYY ADSVKGRFTI SRDNSKNTLY
LQMNSLRAED TAVYYCAKHR RDYVWWTYGM DVWGQGTTVT
VSSASTKGPS VFPLAP

>HC-098-E09 (SEQ ID NO:1227)
EVQLLESGGG LVQPGGSLRL SCAASGFTFS RYGMWWVRQA
PGKGLEWVSY IYPSGGGTVY ADSVKGRFTI SRDNSKNTLY
LQMNSLRAED TAVYYCARRV AVAGSWYYYY YGMDVWGQGT
TVTVSSASTK GPSVFPLAP

>HC-098-H04 (SEQ ID NO:1228)
EVQLLESGGG LVQPGGSLRL SCAASGFTFS HYVMSWVRQA
PGKGLEWVSR IYPSGGQTYY ADSVKGRFTI SRDNSKNTLY
LQMNSLRAED TAVYYCARGA GWFDPWGQGT LVTVSSASTK
GPSVFPLAP

>HC-099-A09 (SEQ ID NO:1229)
EVQLLESGGG LVQPGGSLRL SCAASGFTFS RYAMFWVRQA
PGKGLEWVSS ISPSGGKTRY ADSVKGRFTI SRDNSKNTLY
LQMNSLRAED TAVYYCARGG GTALDYWGQG TLVTVSSAST
KGPSVFPLAP

>HC-099-C12 (SEQ ID NO:1230)
EVQLLESGGG LVQPGGSLRL SCAASGFTFS RYAMHWVRQA
PGKGLEWVSS IWPSGGATFY ADSVKGRFTI SRDNSKNTLY
LQMNSLRAED TAVYYCATSP TLNAFHIWGQ GTMVTVSSAS
TKGPSVFPLA P

>HC-099-D05 (SEQ ID NO:1231)
EVQLLESGGG LVQPGGSLRL SCAASGFTFS NYIMSWVRQA
PGKGLEWVSS IWPSGGHTRY ADSVKGRFTI SRDNSKNTLY
LQMNSLRAED TAVYYCARAG SYYAGDYWGQ GTLVTVSSAS
TKGPSVFPLA P

>HC-099-E11 (SEQ ID NO:1232)
EVQLLESGGG LVQPGGSLRL SCAASGFTFS HYTMVWVRQA
PGKGLEWVSS IYSSGGRTNY ADSVKGRFTI SRDNSKNTLY
LQMNSLRAED TAVYYCARIV VVPSAQFYFY YGMDVWGQGT
TVTVSSASTK GPSVFPLAP

>HC-101-E01 (SEQ ID NO:1233)
EVQLLESGGG LVQPGGSLRL SCAASGFTFS PYIMSWVRQA
PGKGLEWVSS IVSSGGVTLY ADSVKGRFTI SRDNSKNTLY
LQMNSLRAED TAVYYCTKNI NLRYDILTGY FDIWGQGTTV
TVSSASTKGP SVFPLAP

>HC-102-A04 (SEQ ID NO:1234)
EVQLLESGGG LVQPGGSLRL SCAASGFTFS HYVMNWVRQA
PGKGLEWVSR IYPSGGVTVY ADSVKGRFTI SRDNSKNTLY
LQMNSLRAED TAVYYCARGY GMDVWGQGTM VTVSSASTKG
PSVFPLAP

>HC-102-C02 (SEQ ID NO:1235)
EVQLLESGGG LVQPGGSLRL SCAASGFTFS HYLMHWVRQA
PGKGLEWVSS IYPSGGKTQY ADSVKGRFTI SRDNSKNTLY
LQMNSLRAED TAVYYCARVF GYYDFWSGYP GAFDYWGQGT
LVTVSSASTK GPSVFPLAP

-continued

```
>HC-102-C12 (SEQ ID NO:1236)
EVQLLESGGG LVQPGGSLRL SCAASGFTFS HYLMGWVRQA
PGKGLEWVSV IWPSGGITKY ADSVKGRFTI SRDNSKNTLY
LQMNSLRAED TAVYYCARGN GGFDSWGQGT LVTVSSASTK
GPSVFPLAP

>HC-102-D07 (SEQ ID NO:1237)
EVQLLESGGG LVQPGGSLRL SCAASGFTFS RYWMWWVRQA
PGKGLEWVSS IGPSGGATRY ADSVKGRFTI SRDNSKNTLY
LQMNSLRAED TAVYYCTTGS AGNWGQGTLV TVSSASTKGP
SVFPLAP

>HC-102-E09 (SEQ ID NO:1238)
EVQLLESGGG LVQPGGSLRL SCAASGFTFS LYLMEWVRQA
PGKGLEWVSS IGSSGATWY ADSVKGRFTI SRDNSKNTLY
LQMNSLRAED TAMYYCATDT SRVAGTRLRN YYYYYGMDVW
GQGTTVTVSS ASTKGPSVFP LAP

>HC-102-G11 (SEQ ID NO:1239)
EVQLLESGGG LVQPGGSLRL SCAASGFTFS RYMMEWVRQA
PGKGLEWVSG ISPSGGTTKY ADSVKGRFTI SRDNSKNTLY
LQMNSLRAED TAVYYCTRGG YNNYYYALDV WGQGTTVTVS
SASTKGPSVF PLAP

>HC-102-G12 (SEQ ID NO:1240)
EVQLLESGGG LVQPGGSLRL SCAASGFTFS KYKMVWVRQA
PGKGLEWVSS IYPSGGITAY ADSVKGRFTI SRDNSKNTLY
LQMNSLRAED TAMYYCAKDI TPGGGSGFRL PKNYYYYGMD
VWGQGTTVTV SSASTKGPSV FPLAP

>HC-102-H02 (SEQ ID NO:1241)
EVQLLESGGG LVQPGGSLRL SCAASGFTFS MYRMFWVRQA
PGKGLEWVSV IGPSGGQTAY ADSVKGRFTI SRDNSKNTLY
LQMNSLRAED TAVYYCARVG VWYGMDVWGQ GTTVTVSSAS
TKGPSVFPLA P

>HC-102-H11 (SEQ ID NO:1242)
EVQLLESGGG LVQPGGSLRL SCAASGFTFS KYPMTWVRQA
PGKGLEWVSS ISSSGGKTQY ADSVKGRFTI SRDNSKNTLY
LQMNSLRAED TAVYYCTRGG SSTLYFMDVW GQGTTVTVSS
ASTKGPSVFP LAP

>HC-103-A03 (SEQ ID NO:1243)
EVQLLESGGG LVQPGGSLRL SCAASGFTFS HYPMSWVRQA
PGKGLEWVSY IRSGGYTTYA DSVKGRFTIS RDNSKNTLYL
QMNSLRAEDT AVYYCARERV FCSGGRCGSY FDYWGQGTLV
TVSSASTKGP SVFPLAP

>HC-103-E09 (SEQ ID NO:1244)
EVQLLESGGG LVQPGGSLRL SCAASGFTFS HYSMLWVRQA
PGKGLEWVSS IRPSGGFTKY ADSVKGRFTI SRDNSKNTLY
LQMNSLRAED TAVYYCARRG VWDAFDIWGQ GTMVTVSSAS
TKGPSVFPLA P

>HC-103-F07 (SEQ ID NO:1245)
EVQLLESGGG LVQPGGSLRL SCAASGFTFS LYAMHWVRQA
PGKGLEWVSS IRPSGGLTKY ADSVKGRFTI SRDNSKNTLY
LQMNSLRAED TAVYYCARVG VWYGMDVWGQ GTTVTVSSAS
TKGPSVFPLA P

>HC-103-H07 (SEQ ID NO:1246)
EVQLLESGGG LVQPGGSLRL SCAASGFTFS HYGMYWVRQA
PGKGLEWVSS IYPSGGWTNY ADSVKGRFTI SRDNSKNTLY
LQMNSLRAED TAVYYCARRG SWGAFDIWGQ GTMVTVSSAS
TKGPSVFPLA P

>HC-104-A12 (SEQ ID NO:1247)
EVQLLESGGG LVQPGGSLRL SCAASGFTFS HYNMGWVRQA
PGKGLEWVSR IGSSGGKTAY ADSVKGRFTI SRDNSKNTLY
LQMNSLRAED TAVYYCAKTN YDFWSGYLPN PNPYPLDYWG
QGTLVTVSSA STKGPSVFPL AP

>HC-104-B03 (SEQ ID NO:1248)
EVQLLESGGG LVQPGGSLRL SCAASGFTFS NYTMFWVRQA
PGKGLEWVSS IYPSGGITRY ADSVKGRFTI SRDNSKNTLY
LQMNSLRAED TAVYYCARVS FWNAFDIWGQ GTMVTVSSAS
TKGPSVFPLA P

>HC-104-B12 (SEQ ID NO:1249)
EVQLLESGGG LVQPGGSLRL SCAASGFTFS IYAMIWVRQA
PGKGLEWVSS IYSSGGPTQY ADSVKGRFTI SRDNSKNTLY
LQMNSLRAED TAVYYCARGR RTYYYDSSGY YKYAAFDIWG
QGTMVTVSSA STKGPSVFPL AP

>HC-104-D12 (SEQ ID NO:1250)
EVQLLESGGG LVQPGGSLRL SCAASGFTFS HYAMFWVRQA
PGKGLEWVSS IWPSGGKTMY ADSVKGRFTI SRDNSKNTLY
LQMNSLRAED TATYYCARGG SYLAFDIWGQ GTMVTVSSAS
TKGPSVFPLA P

>HC-104-H12 (SEQ ID NO:1251)
EVQLLESGGG LVQPGGSLRL SCAASGFTFS YYQMSWVRQA
PGKGLEWVSR IGPSGGLTSY ADSVKGRFTI SRDNSKNTLY
LQMNSLRAED TAVYYCARVG VWYGMDVWGQ GTLVTVSSAS
TKGPSVFPLA P

>HC-105-B06 (SEQ ID NO:1252)
EVQLLESGGG LVQPGGSLRL SCAASGFTFS HYAMGWVRQA
PGKGLEWVSR IWPSGGHTQY ADSVKGRFTI SRDNSKNTLY
LQMNSLRAED TAMYYCATGY SSTWGAFDIW GQGTMVTVSS
ASTKGPSVFP LAP

>HC-105-F02 (SEQ ID NO:1253)
EVQLLESGGG LVQPGGSLRL SCAASGFTFS RYWMAWVRQA
PGKGLEWVSS IGPSGGSTKY ADSVKGRFTI SRDNSKNTLY
LQMNSLRAED TAVYYCARTA RWLSFDYWGQ GTLVTVSSAS
TKGPSVFPLA P

>HC-106-C06 (SEQ ID NO:1254)
EVQLLESGGG LVQPGGSLRL SCAASGFTFS HYTMQWVRQA
PGKGLEWVSS IYPSGGATKY ADSVKGRFTI SRDNSKNTLY
LQMNSLRAED TAMYYCARSG YYYGLDVWGQ GTTVTVSSAS
TKGPSVFPLA P

>HC-106-D06 (SEQ ID NO:1255)
EVQLLESGGG LVQPGGSLRL SCAASGFTFS YYLMGWVRQA
PGKGLEWVSS IGPSGGTTKY ADSVKGRFTI SRDNSKNTLY
LQMNSLRAED TAVYYCARRG LGAAFDYWGQ GTLVTVSSAS
TKGPSVFPLA P

>HC-106-E12 (SEQ ID NO:1256)
EVQLLESGGG LVQPGGSLRL SCAASGFTFS HYNMTWVRQA
PGKGLEWVSS IWPSGGATRY ADSVKGRFTI SRDNSKNTLY
LQMNSLRAED TAVYYCARTS RFYGMDVWGQ GTTVTVSSAS
TKGPSVFPLA P

>HC-106-G12 (SEQ ID NO:1257)
EVQLLESGGG LVQPGGSLRL SCAASGFTFS WYRMHWVRQA
PGKGLEWVSS IWPSGGKTHY ADSVKGRFTI SRDNSKNTLY
LQMNSLRAED TAVYYCARAL QYGSGSYFYA PKSYYYYGMD
VWGQGTTVTV SSASTKGPSV FPLAP

>HC-107-B05 (SEQ ID NO:1258)
EVQLLESGGG LVQPGGSLRL SCAASGFTFS HYLMMWVRQA
PGKGLEWVSS IRSSGGITRY ADSVKGRFTI SRDNSKNTLY
LQMNSLRAED TAVYYCARVG YYYGMDVWGQ GTTVTVSSAS
TKGPSVFPLA P

>HC-107-D01 (SEQ ID NO:1259)
EVQLLESGGG LVQPGGSLRL SCAASGFTFS WYGMWVRQA
PGKGLEWVSV IRPSGGTTRY ADSVKGRFTI SRDNSKNTLY
LQMNSLRAED TAVYYCARGG RYYSLDYWGQ GTLVTVSSAS
TKGPSVFPLA P

>HC-107-D05 (SEQ ID NO:1260)
EVQLLESGGG LVQPGGSLRL SCAASGFTFS NYHMQWVRQA
PGKGLEWVSS IYPSGGFTRY ADSVKGRFTI SRDNSKNTLY
LQMNSLRAED TAVYYCARDG GQGGWGQGTL VTVSSASTKG
PSVFPLAP

>HC-107-D12 (SEQ ID NO:1261)
EVQLLESGGG LVQPGGSLRL SCAASGFTFS MYKMGWVRQA
PGKGLEWVSS IVPSGGKTQY ADSVKGRFTI SRDNSKNTLY
LQMNSLRAED TAVYYCAKDI TPGGGFGVPL A.KLLLL
```

-continued

>HC-107-F11 (SEQ ID NO:1262)
EVQLLESGGG LVQPGGSLRL SCAASGFTFS HYQMHWVRQA
PGKGLEWVSS IRPSGGRTAY ADSVKGRFTI SRDNSKNTLY
LQMNSLRAED TAVYYCARVG VWYGMDVWGQ GTTVTVSSAS
TKGPSVFPLA P

>HC-108-C10 (SEQ ID NO:1263)
EVQLLESGGG LVQPGGSLRL SCAASGFTFS RYVMAWVRQA
PGKGLEWVSV IRPSGGKTLY ADSVKGRFTI SRDNSKNTLY
LQMNSLRAED TAVYYCARVA GRVGVPATKK NWFDPWGQGT
LVTVSSASTK GPSVFPLAP

>HC-108-D11 (SEQ ID NO:1264)
EVQLLESGGG LVQPGGSLRL SCAASGFTFS WYVMTWVRQA
PGKGLEWVSV IYPSGGATKY ADSVKGRFTI SRDNSKNTLY
LQMNSLRAED TAVYYCARRG AGGMDVWGQG TTVTVSSAST
KGPSVFPLAP

>HC-108-E10 (SEQ ID NO:1265)
EVQLLESGGG LVQPGGSLRL SCAASGFTFS RYRMVWVRQA
PGKGLEWVSS IYPSGGYTKY ADSVKGRFTI SRDNSKNTLY
LQMNSLRAED TAVYYCARVI TYNNFDSWGQ GTLVTVSSAS
TKGPSVFPLA P

>HC-108-E11 (SEQ ID NO:1266)
EVQLLESGGG LVQPGGSLRL SCAASGFTFS NYSMMWVRQA
PGKGLEWVSS IYPSGGFTKY ADSVKGRFTI SRDNSKNTLY
LQMNSLRAED TAVYYCARVG FYGGFVWGQG TTVTVSSAST
KGPSVFPLAP

>HC-109-A11 (SEQ ID NO:1267)
EVQLLESGGG LVQPGGSLRL SCAASGFTFS NYTMTWVRQA
PGKGLEWVSV IYPSGGHTTY ADSVKGRFTI SRDNSKNTLY
LQMNSLRAED TAMYYCARGG RWFSLDYWGQ GTLVTVSSAS
TKGPSVFPLA P

>HC-109-E08 (SEQ ID NO:1268)
EVQLLESGGG LVQPGGSLRL SCAASGFTFS HYTMLWVRQA
PGKGLEWVSS IYSSGGSTYY ADSVKGRFTI SRDNSKNTLY
LQMNSLRAED TAVYYCARVG VWYGMDVWGQ GTTVTVSSAS
TKGPSVFPLA P

>HC-110-D06 (SEQ ID NO:1269)
EVQLLESGGG LVQPGGSLRL SCAASGFTFS WYRMAWVRQA
PGKGLEWVSY IGPSGGSTSY ADSVKGRFTI SRDNSKNTLY
LQMWSLRAED TATYYCARVG TFYGMDVWGQ GTTVTVSSAS
TKGPSVFPLA P

>HC-110-D11 (SEQ ID NO:1270)
EVQLLESGGG LVQPGGSLRL SCAASGFTFS HYLMYWVRQA
PGKGLEWVSR IGPSGGWTKY ADSVKGRFTI SRDNSKNTLY
LQMNSLRAED TAVYYCARVG VWYGMDVWGQ GTTVTVSSAS
TKGPSVFPLA P

>HC-110-F08 (SEQ ID NO:1271)
EVQLLESGGG LVQPGGSLRL SCAASGFTFS NYVMYWVRQA
PGKGLEWVSG IGPSGGFTTY ADSVKGRFTI SRDNSKNTLY
LQMNSLRAED TAVYYCTRDR YFGSGYYMAA YYYYGMDVWG
QGTTVTVSSA STKGPSVFPL AP

>HC-110-G01 (SEQ ID NO:1272)
EVQLLESGGG LVQPGGSLRL SCAASGFTFS MYKMGWVRQA
PGKGLEWVSS IVPSGGKTQY ADSVKGRFTI SRDNSKNTLY
LQMNSLRAED TAVYYCAKDI TPGGGSGFRL PKNYYYGMD
VWGQGTTVTV SSASTKGPSV FPLAP

>HC-110-H11 (SEQ ID NO:1273)
EVQLLESGGG LVQPGGSLRL SCAASGFTFS HYKMEWVRQA
PGKGLEWVSR IRPSGGVTKY ADSVKGRFTI SRDNSKNTLY
LQMNSLRAED TAVYYCTRGG LWDAFDIWGQ GTMVTVSSAS
TKGPSVFPLA P

>HC-111-B02 (SEQ ID NO:1274)
EVQLLESGGG LVQPGGSLRL SCAASGFTFS KYWMAWVRQA
PGKGLEWVSV IYPSGGQTKY ADSVKGRFTI SRDNSKNTLY
LQMNSLRAED TAVYYCTLMR YGDRFDYWGQ GTLVTVSSAS
TKGPSVFPLA P

>HC-111-C10 (SEQ ID NO:1275)
EVQLLESGGG LVQPGGSLRL SCAASGFTFS RYVMSWVRQA
PGKGLEWVSS IRSSGGRTMY ADSVKGRFTI SRDNSKNTLY
LQMNSLRAED TAVYYCARVG VWYGMDVWGQ GTTVTVSSAS
TKGPSVFPLA P

>HC-111-D11 (SEQ ID NO:1276)
EVQLLESGGG LVQPGGSLRL SCAASGFTFS WYANMWVRQA
PGKGLEWVSS IWPSGGHTKY ADSVKGRFTI SRDNSKNTLY
LQMNSLRAED TAVYYCATDQ GYFWGQGTLV TVSSASTKGP
SVFPLAP

>HC-112-C02 (SEQ ID NO:1277)
EVQLLESGGG LVQPGGSLRL SCAASGFTFS NYYMLWVRQA
PGKGLEWVSY IRSSGGSTRY ADSVKGRFTI SRDNSKNTLY
LQMNSLRAED TAVYYCAKPT VDGAFDYWGQ GTLVTVSSAS
TKGPSVFPLA P

>HC-112-C12 (SEQ ID NO:1278)
EVQLLESGGG LVQPGGSLRL SCAASGFTFS RYMMYWVRQA
PGKGLEWVSS IYPSGGKTLY ADSVKGRFTI SRDNSKNTLY
LQMNSLRAED TAVYYCARVG VWYGMDVWGQ GTTVTVSSAS
TKGPSVFPLA P

>HC-112-D04 (SEQ ID NO:1279)
EVQLLESGGG LVQPGGSLRL SCAASGFTFS HYVMVWVRQA
PGKGLEWVSG IRSSGGVTAY ADSVKGRFTI SRDNSKNTLY
LQMNSLRAED TAMYYCARVG VWYGMDVWGQ GTTVTVSSAS
TKGPSVFPLA P

>HC-112-D07 (SEQ ID NO:1280)
EVQLLESGGG LVQPGGSLRL SCAASGFTFS FYSMSWVRQA
PGKGLEWVSR IRPSGGRTDY ADSVKGRFTI SRDNSKNTLY
LQMNSLRAED TAVYYCARDR LYYYGSGSYY YCAFDIWGQG
TMVTVSSAST KGPSVFPLAP

>HC-113-D05 (SEQ ID NO:1281)
EVQLLESGGG LVQPGGSLRL SCAASGFTFS HYIMMWVRQA
PGKGLEWVSS IYPSGGSTIY ADSVKGRFTI SRDNSKNTLY
LQMNSLRAED TAVYYCASAT EGYYYGMDVW GQGTTVTVSS
ASTKGPSVFP LAP

>HC-113-E03 (SEQ ID NO:1282)
EVQLLESGGG LVQPGGSLRL SCAASGFTFS RYTMFWVRQA
PGKGLEWVSG IYPSGGKTIY ADSVKGRFTI SRDNSKNTLY
LQMNSLRAED TAVYYCATGG VFGVVDYWGQ GTLVTVSSAS
TKGPSVFPLA P

>HC-113-G11 (SEQ ID NO:1283)
EVQLLESGGG LVQPGGSLRL SCAASGFTFS HYMMQWVRQA
PGKGLEWVSG IGPSGGWTKY ADSVKGRFTI SRDNSKNTLY
LQMNSLRAED TALYYCARLN YGDYVWGQGT LVTVSSASTK
GPSVFPLAP

>HC-114-E02 (SEQ ID NO:1284)
EVQLLESGGG LVQPGGSLRL SCAASGFTFS HYKMMWVRQA
PGKGLEWVSY IYPSGGWTGY ADSVKGRFTI SRDNSKNTLY
LQMNSLRAED TAVYYCARVG PWDAFDIWGQ GTMVTVSSAS
TKGPSVFPLA P

>HC-114-F04 (SEQ ID NO:1285)
EVQLLESGGG LVQPGGSLRL SCAASGFTFS HYYMAWVRQA
PGKGLEWVSY ISPSGGSTKY ADSVKGRFTI SRDNSKNTLY
LQMNSLRAED TAMYYCARGG GTGTFDIWGQ GTMVTVSSAS
TKGPSVFPLA P

>HC-114-G06 (SEQ ID NO:1286)
EVQLLESGGG LVQPGGSLRL SCAASGFTFS YYEMEWVRQA
PGKGLEWVSS IRPSGGRTVY ADSVKGRFTI SRDNSKNTLY
LQMNSLRAED TAVYYCAKGR SNYYGSGSYS PKYFQHWGQG
TLVTVSSAST KGPSVFPLAP

>HC-114-G09 (SEQ ID NO:1287)
EVQLLESGGG LVQPGGSLRL SCAASGFTFS HYAMDWVRQA
PGKGLEWVSV IYSSGGKTTY ADSVKGRFTI SRDNSKNTLY
LQMNSLRAED TAMYYCARVG VWYGMDVWGQ GTTVTVSSAS
TKGPSVFPLA P

```
>HC-114-H07 (SEQ ID NO:1288)
EVQLLESGGG LVQPGGSLRL SCAASGFTFS HYLMHWVRQA
PGKGLEWVSV IYPSGGTTKY ADSVKGRFTI SRDNSKNTLY
LQMNSLRAED TAMYYCARGN SGSHDYWGQG TLVTVSSAST
KGPSVFPLAP

>HC-115-F04 (SEQ ID NO:1289)
EVQLLESGGG LVQPGGSLRL SCAASGFTFS NYLMGWVRQA
PGKGLEWVSS IGPSGGYTKY ADSVKGRFTI SRDNSKNTLY
LQMNSLRAED TAVYYCARGT GTTFFWGQGT LVTVSSASTK
GPSVFPLAP

>NC-115-F08 (SEQ ID NO:1290)
EVQLLESGGG LVQPGGSLRL SCAASGFTFS HYVMVWVRQA
PGKGLEWVSS IYPSGGMTVY ADSVKGRFTI SRDNSKNTLY
LQMNSLRAED TAVYYCARRG IANSFNIWGQ GTMVTVSSAS
TKGPSVFPLA P

>HC-115-G12 (SEQ ID NO:1291)
EVQLLESGGG LVQPGGSLRL SCAASGFTFS PYFMEWVRQA
PGKGLEWVSG ISSSGGNTLY ADSVKGRFTI SRDNSKNTLY
LQMNSLRAED TAVYYCARDR FGNYYGSGSK LQHDAFDIWG
QGTMVTVSSA STKGPSVFPL AP

>HC-116-A08 (SEQ ID NO:1292)
EVQLLESGGG LVQPGGSLRL SCAASGFTFS YYMMGWVRQA
PGKGLEWVSS IYTSGGYTKY ADSVKGRFTI SRDNSKNTLY
LQMNSLRAED TAVYYCARAS IYYGMDVWGQ GTTVTVSSAS
TKGPSVFPLA P

>HC-116-C09 (SEQ ID NO:1293)
EVQLLESGGG LVQPGGSLRL SCAASGFTFS NYKMHWVRQA
PGKGLEWVSS IYPSGGWTVY ADSVKGRFTI SRDNSKNTLY
LQMNSLRAED TAVYYCATGY SSTWGAFDIW GQGTMVTVSS
ASTKGPSVFP LAP

>HC-116-E08 (SEQ ID NO:1294)
EVQLLESGGG LVQPGGSLRL SCAASGFTFS RYPMIWVRQA
PGKGLEWVSV IYPSGGMTKY ADSVKGRFTI SRDNSKNTLY
LQMNSLRAED TAVYYCARVG SYGSLGYWGQ GTLVTVSSAS
TKGPSVFPLA P

>HC-117-A12 (SEQ ID NO:1295)
EVQLLESGGG LVQPGGSLRL SCAASGFTFS NYKMSWVRQA
PGKGLEWVSG IYPSGGLTQY ADSVKGRFTI SRDNSKNTLY
LQMNSLRAED TAVYYCAKVG VWYGMDVWGQ GTTVTVSSAS
TKGPSVFPLA P

>HC-117-B07 (SEQ ID NO:1296)
EVQLLESGGG LVQPGGSLRL SCAASGFTFS HYTMWWVRQA
PGKGLEWVSR IWPSGGTTRY ADSVKGRFTI SRDNSKNTLY
LQMNSLRAED TAVYYCARGG SYLAFDIWGQ GTMVTVSSAS
TKGPSVFPLA P

>HC-117-C04 (SEQ ID NO:998)
EVQLLESGGG LVQPGGSLRL SCAASGFTFS HYLMFWVRQA
PGKGLEWVSS IWPSGGNTKY ADSVKGRFTI SRDNSKNTLY
LQMNSLRAED TAVYYCARPA YYYAMDVWGQ GTTVTVSSAS
TKGPSVFPLA P

>HC-117-F04 (SEQ ID NO:1008)
EVQLLESGGG LVQPGGSLRL SCAASGFTFS MYVMNWVRQA
PGKGLEWVSR IGSSGGGTLY ADSVKGRFTI SRDNSKNTLY
LQMNSLRAED TAVYYCARVS VYRIRNYYYY AMDVWGQGTT
VTVSSASTKG PSVFPLAP

>HC-118-E07 (SEQ ID NO:1010)
EVQLLESGGG LVQPGGSLRL SCAASGFTFS HYPMDWVRQA
PGKGLEWVSR IYPSGGATKY ADSVKGRFTI SRDNSKNTLY
LQMNSLRAED TATYYCARGG GAFDIWGQGT MVTVSSASTK
GPSVFPLAP

>HC-119-B09 (SEQ ID NO:324)
EVQLLESGGG LVQPGGSLRL SCAASGFTFS WYWMYWVRQA
PGKGLEWVSV IGSSGGVTKY ADSVKGRFTI SRDNSKNTLY
LQMNSLRAED TATYYCARGP YRGYFDYWGQ GTLVTVSSAS
TKGPSVFPLA P

>HC-121-A07 (SEQ ID NO:336)
EVQLLESGGG LVQPGGSLRL SCAASGFTFS HYLMYWVRQA
PGKGLEWVSR IYPSGGATSY ADSVKGRFTI SRDNSKNTLY
LQMNSLRAED TAVYYCAKSG SWYSFDYWGQ GTLVTVSSAS
TKGPSVFPLA P

>HC-121-H07 (SEQ ID NO:340)
EVQLLESGGG LVQPGGSLRL SCAASGFTFS KYYMVWVRQA
PGKGLEWVSV IGPSGGWTTY ADSVKGRFTI SRDNSKNTLY
LQMNSLRAED TAVYYCARVD YSNYFDYWGQ GTLVTVSSAS
TKGPSVFPLA P

>HC-122-A05 (SEQ ID NO:343)
EVQLLESGGG LVQPGGSLRL SCAASGFTFS HYPMHWVRQA
PGKGLEWVSS IWPSGGHTSY ADSVKGRFTI SRDNSKNTLY
LQMNSLRAED TATYYCARLS QPIWGQGTLV TVSSASTKGP
SVFPLAP

>HC-122-D01 (SEQ ID NO:344)
EVQLLESGGG LVQPGGSLRL SCAASGFTFS HYIMHWVRQA
PGKGLEWVSG IYPSGGSTKY ADSVKGRFTI SRDNSKNTLY
LQMNSLRAED TAVYYCARAL VGALDYWGQG TLVTVSSAST
KGPSVFPLAP

>HC-122-G06 (SEQ ID NO:354)
EVQLLESGGG LVQPGGSLRL SCAASGFTFS WYAMHWVRQA
PGKGLEWVSV ISPSGGATRY ADSVKGRFTI SRDNSKNTLY
LQMNSLRAED TAVYYCVRAS TVTTLFQHWG QGTLVTVSSA
STKGPSVFPL AP

>HC-122-H04 (SEQ ID NO:362)
EVQLLESGGG LVQPGGSLRL SCAASGFTFS RYAMAWVRQA
PGKGLEWVSR IGSSGGVTRY ADSVKGRFTI SRDNSKNTLY
LQMNSLRAED TAVYYCAAPR GRYYYDSSGY YYGGVFDYWG
QGTLVTVSSA STKGPSVFPL AP

>NC-123-E02 (SEQ ID NO:366)
EVQLLESGGG LVQPGGSLRL SCAASGFTFS HYRMDWVRQA
PGKGLEWVSG IYPSGGHTNY ADSVKGRFTI SRDNSKNTLY
LQMNSLRAED TAVYYCARDR GWYGADYWGQ GTLVTVSSAS
TKGPSVFPLA P

>HC-124-A01 (SEQ ID NO:398)
EVQLLESGGG LVQPGGSLRL SCAASGFTFS NYPMYWVRQA
PGKGLEWVSR IGPSGGHTDY ADSVKGRFTI SRDNSKNTLY
LQMNSLRAED TAVYYCARAG VWSGLDYWGQ GTLVTVSSAS
TKGPSVFPLA P

>HC-124-C04 (SEQ ID NO:414)
EVQLLESGGG LVQPGGSLRL SCAASGFTFS WYLMGWVRQA
PGKGLEWVSV IGPSGGLTKY ADSVKGRFTI SRDNSKNTLY
LQMNSLRAED TAVYYCARFR GYYGMDVWGQ GTTVIVSSAS
TKGPSVFPLA P

>HC-124-C12 (SEQ ID NO:416)
EVQLLESGGG LVQPGGSLRL SCAASGFTFS WYTMQWVRQA
PGKGLEWVSR IYSSGGGTYY ADSVKGRFTI SRDNSKNTLY
LQMNSLRAED TAMYYCARVG PWGAFDIWGQ GTMVTVSSAS
TKGPSVFPLA P

>HC-124-G12 (SEQ ID NO:420)
EVQLLESGGG LVQPGGSLRL SCAASGFTFS HYWMRWVRQA
PGKGLEWVSS IGSSGGMTKY ADSVKGRFTI SRDNSKNTLY
LQMNSLRAED TAVYYCARAL RWRAFDIWGQ GTMVTVSSAS
TKGPSVFPLA P

>HC-124-H10 (SEQ ID NO:426)
EVQLLESGGG LVQPGGSLRL SCAASGFTFS NYFMNWVRQA
PGKGLEWVSS IGSSGGYTRY ADSVKGRFTI SRDNSKNTLY
LQMNSLRAED TAVYYCARVG VWYGMDVWGQ GTTVTVSSAS
TKGPSVFPLA P

>HC-125-C04 (SEQ ID NO:432)
EVQLLESGGG LVQPGGSLRL SCAASGFTFS HYVMDWVRQA
PGKGLEWVSS IYPSGGWTRY ADSVKGRFTI SRDNSRNTLY
LQMNSLRAED TAVYYCARRG QWLVLDYWGQ GTLVTVSSAS
TKGPSVFPLA P
```

-continued

```
>HC-126-B12 (SEQ ID NO:434)
EVQLLESGGG LVQPGGSLRL SCAASGFTFS HYVMGWVRQA
PGKGLEWVSS IYPSGGKTTY ADSVKGRFTI SRDNSKNTLY
LQMNSLRAED TAVYYCASPS TGSWSAFDIW GQGTMVTVSS
ASTKGPSVFP LAP

>HC-126-C10 (SEQ ID NO:446)
EVQLLESGGG LVQPGGSLRL SCAASGFTFS HYKMHWVRQA
PGKGLEWVSS IWPSGGGTFY ADSVKGRFTI SRDNSKNTLY
LQMNSLRAED TAMYYCARTS GGFGAFDIWG QGTMVTVSSA
STKGPSVFPL AP

>HC-126-F11 (SEQ ID NO:464)
EVQLLESGGG LVQPGGSLRL SCAASGFTFS HYWMMWVRQA
PGKGLEWVSW IGSSGGFTWY ADSVKGRFTI SRDNSKNTLY
LQMNSLRAED TAVYYCARGN GGFDSWGQGT LVTVSSASTK
GPSVFPLAP

>HC-126-H09 (SEQ ID NO:499)
EVQLLESGGG LVQPGGSLRL SCAASGFTFS NYTMMWVRQA
PGKGLEWVSG IYPSGGQTAY ADSVKGRFTI SRDNSKNTLY
LQMNSLRAED TAVYYCARGG SWYAFDIWGQ GTMVTVSSAS
TKGPSVFPLA P

>HC-127-C06 (SEQ ID NO:500)
EVQLLESGGG LVQPGGSLRL SCAASGFTFS NYPMHWVRQA
PGKGLEWVSY IGPSGGWTRY ADSVKGRFTI SRDNSKNTLY
LQMNSLRAED TAVYYCARAP SGYWGQGTLV TVSSASTKGP
SVFPLAP

>HC-127-D05 (SEQ ID NO:506)
EVQLLESGGG LVQPGGSLRL SCAASGFTFS HYYMMWVRQA
PGKGLEWVSS IGPSGGMTDY ADSVKGRFTI SRDNSKNTLY
LQMNSLRAED TAVYYCATGG TASLDYWGQG TLVTVSSAST
KGPSVFPLAP

>HC-127-H05 (SEQ ID NO:536)
EVQLLESGGG LVQPGGSLRL SCAASGFTFS HYLMGWVRQA
PGKGLEWVSS IWPSGGHTSY ADSVKGRFTI SRDNSKNTLY
LQMNSLRAED TAVYYCARHY GMDVWGQGTT VTVSSASTKG
PSVFPLAP

>HC-128-A06 (SEQ ID NO:540)
EVQLLESGGG LVQPGGSLRL SCAASGFTFS HYKMNWVRQA
PGKGLEWVSY IGSSGGKTGY ADSVKGRFTI SRDNSKNTLY
LQMNSLRAED TALYYCARVG VWYGMDVWGQ GTLVTVSSAS
TKGPSVFPLA P

>HC-128-E07 (SEQ ID NO:558)
EVQLLESGGG LVQPGGSLRL SCAASGFTFS FYPMSWVRQA
PGKGLEWVSY IWPSGGATRY ADSVKGRFTI SRDNSKNTLY
LQMNSLRAED TAVYYCARGN GGFDSWGQGT LVTVSSASTK
GPSVFPLAP

>HC-128-F11 (SEQ ID NO:560)
EVQLLESGGG LVQPGGSLRL SCAASGFTFS FYVMGWVRQA
PGKGLEWVSW IGPSGGRTWY ADSVKGRFTI SRDNSKNTLY
LQMNSLRAED TAVYYCARDR GWYGIDVWGQ GTTVTVSSAS
TKGPSVFPLA P

>HC-129-B09 (SEQ ID NO:564)
EVQLLESGGG LVQPGGSLRL SCAASGFTFS RYWMHWVRQA
PGKGLEWVSS IGPSGGVTKY ADSVKGRFTI SRDNSKNTLY
LQMNSLRAED TAVYYCARHG SWGGMDVWGQ GTTVTVSSAS
TKGPSVFPLA P

>HC-130-B02 (SEQ ID NO:571)
EVQLLESGGG LVQPGGSLRL SCAASGFTFS NYSMVWVRQA
PGKGLEWVSR IYSSGGSTHY ADSVKGRFTI SRDNSKNTLY
LQMNSLRAED TAVYYCARVG VWYGMDVWGQ GTTVTVSSAS
TKGPSVFPLA P

>HC-131-A03 (SEQ ID NO:572)
EVQLLESGGG LVQPGGSLRL SCAASGFTFS WYTMGWVRQA
PGKGLEWVSV IYPSGGMTKY ADSVKGRFTI SRDNSKNTLY
LQMNSLRAED TAVYYCARTS GGTPWGFWGQ GTLVTVSSAS
TKGPSVFPLA P

>HC-131-B05 (SEQ ID NO:578)
EVQLLESGGG LVQPGGSLRL SCAASGFTFS HYVMSWVRQA
PGKGLEWVSY IYPSGGKTHY ADSVKGRFTI SRDNSKNTLY
LQMNSLRAED TAVYYCARVG VWYGMDVWGQ GTTVTVSSAS
TKGPSVFPLA P

>HC-131-D01 (SEQ ID NO:595)
EVQLLESGGG LVQPGGSLRL SCAASGFTFS HYNMNWVRQA
PGKGLEWVSV IYPSGGQTHY ADSVKGRFTI SRDNSKNTLY
LQMNSLRAED TAVYYCARRG IWHSFDIWGQ GTMVTVSSAS
TKGPSVFPLA P

>HC-131-D12 (SEQ ID NO:596)
EVQLLESGGG LVQPGGSLRL SCAASGFTFS WYNMYWVRQA
PGKGLEWVSY IVPSGGATHY ADSVKGRFTI SRDNSKNTLY
LQMNSLRAED TAVYYCARAL RGYSYGPRGY YYYGMDVWGQ
GTTVTVSSAS TKGPSVFPLA P

>HC-131-F09 (SEQ ID NO:602)
EVQLLESGGG LVQPGGSLRL SCAASGFTFS HYVMQWVRQA
PGKGLEWVSG IGPSGGSTTY ADSVKGRFTI SRDNSKNTLY
LQMNSLRAED TAVYYCARVG VWYGMDVWGQ GTTVTVSSAS
TKGPSVFPLA P

>HC-131-F12 (SEQ ID NO:606)
EVQLLESGGG LVQPGGSLRL SCAASGFTFS RYAMGWVRQA
PGKGLEWVSY IGPSGGNTTY ADSVKGRFTI SRDNSKNTLY
LQMNSLRAED TAVYYCARDV GGSGSYYMLS YYYYGMDVWG
QGTMVTVSSA STKGPSVFPL AP

>HC-131-G03 (SEQ ID NO:621)
EVQLLESGGG LVQPGGSLRL SCAASGFTFS HYVMQWVRQA
PGKGLEWVSS IYPSGGSTRY ADSVKGRFTI SRDNSKNTLY
LQMNSLRAED TAMYYCARFN VGFDLWGRGT LVTVSSASTK
GPSVFPLAP

>HC-131-G06 (SEQ ID NO:631)
EVQLLESGGG LVQPGGSLRL SCAASGFTFS SYAMTWVRQA
PGKGLEWVSS ISSSGGDTAY ADSVKGRFTI SRDNSKNTLY
LQMNSLRAED TAVYYCATER HYIWGSYRYS WFDPWGQGTL
VTVSSASTKG PSVFPLAP

>HC-132-C01 (SEQ ID NO:632)
EVQLLESGGG LVQPGGSLRL SCAASGFTFS RYLMWWVRQA
PGKGLEWVSV IGPSGGWTRY ADSVKGRFTI SRDNSKNTLY
LQMNSLRAED TAVYYCARHP GDYWGQGTLV TVSSASTKGP
SVFPLAP

>HC-132-C08 (SEQ ID NO:660)
EVQLLESGGG LVQPGGSLRL SCAASGFTFS LYFMTWVRQA
PGKGLEWVSS ISSSGGSTKY ADSVKGRFTI SRDNSKNTLY
LQMNSLRAED TAVYYCARGG QWLAFDYWGQ GTLVTVSSAS
TKGPSVFPLA P

>HC-132-D02 (SEQ ID NO:678)
EVQLLESGGG LVQPGGSLRL SCAASGFTFS HYPMDMVRQA
PGKGLEWVSY IGPSGGSTRY ADSVKGRFTI SRDNSKNTLY
LQMNSLRAED TAVYYCARHV PPGTWGQGTL VTVSSASTKG
PSVFPLAP

>HC-132-D08 (SEQ ID NO:702)
EVQLLESGGG LVQPGGSLRL SCAASGFTFS HYLMYWVRQA
PGKGLEWVSW IGPSGGHTMY ADSVKGRFTI SRDNSKNTLY
LQMNSLRAED TAVYYCARLQ QGLDYWGQGT LVTVSSASTK
GPSVFPLAP

>HC-132-H11 (SEQ ID NO:714)
EVQLLESGGG LVQPGGSLRL SCAASGFTFS HYQMHWVRQA
PGKGLEWVSR IRSSGGATSY ADSVKGRFTI SRDNSKNTLY
LQMNSLRAED TAVYYCARGG GYSYYFDYWG QGTLVTVSSA
STKGPSVFPL AP

>HC-133-E02 (SEQ ID NO:721)
EVQLLESGGG LVQPGGSLRL SCAASGFTFS WYTMTWVRQA
PGKGLEWVSS IYPSGGHTSY ADSVKGRFTI SRDNSKNTLY
LQMNSLRAED TAVYYCAKDT RVGPWLVRAP LDYWGQGTLV
TVSSASTKGP SVFPLAP
```

-continued

```
>HC-133-E08 (SEQ ID NO:722)
EVQLLESGGG LVQPGGSLRL SCAASGFTFS KYKMVWVRQA
PGKGLEWVSS IYPSGGITAY ADSVKGRFTI SRDNSKNTLY
LQMNSLRAED TAMYYCAKDI TPGGGSGFRL PKNYYYYGMD
VWGQGTTVTV SSASTKGPSV FPLAP

>HC-134-B03 (SEQ ID NO:758)
EVQLLESGGG LVQPGGSLRL SCAASGFTFS HYSMFWVRQA
PGKGLEWVSS IYPSGGQTDY ADSVKGRFTI SRDNSKNTLY
LQMNSLRAED TAVYYCARRG LLWSFDSWGQ GTLVTVSSAS
TKGPSVFPLA P

>HC-134-D07 (SEQ ID NO:768)
EVQLLESGGG LVQPGGSLRL SCAASGFTFS RYFMIWVRQA
PGKGLEWVSS IVPSGGPTRY ADSVKGRFTI SRDNSKNTLY
LQMNSLRAED TAVYYCARRG PVYYYDSSGS HSAFDIWGQG
TMVTVSSAST KGPSVFPLAP

>HC-135-B05 (SEQ ID NO:786)
EVQLLESGGG LVQPGGSLRL SCAASGFTFS HYLMDWVRQA
PGKGLEWVSV IYPSGGHTNY ADSVKGRFTI SRDNSKNTLY
LQMNSLRAED TAVYYCARVG VWYGMDVWGQ GTTVTVSSAS
TKGPSVFPLA P

>HC-135-C11 (SEQ ID NO:804)
EVQLLESGGG LVQPGGSLRL SCAASGFTFS NYSMQWVRQA
PGKGLEWVSG IRPSGGSTRY ADSVKGRFTI SRDNSKNTLY
LQMNSLRAED TAVYYCAVST GGYYYGMDVW GQGTTVTVSS
ASTKGPSVFP LAP

>HC-135-C12 (SEQ ID NO:813)
EVQLLESGGG LVQPGGSLRL SCAASGFTFS RYHMSWVRQA
PGKGLEWVSS IRPSGGSTIY ADSVKGRFTI SRDNSKNTLY
LQMNSLRAED TAVYYCAREP RRYYYDSSGS YDAFDIWGQG
TMVTVSSAST KGPSVFPLAP

>HC-135-E10 (SEQ ID NO:823)
EVQLLESGGG LVQPGGSLRL SCAASGFTFS WYRMSWVRQA
PGKGLEWVSS ISPSGGPTKY ADSVKGRFTI SRDNSKNTLY
LQMNSLRAED TAVYYCARPS GDSSVYRPFA SWGQGTLVTV
SSASTKGPSV FPLAP

>HC-135-F03 (SEQ ID NO:824)
EVQLLESGGG LVQPGGSLRL SCAASGFTFS HYVMIWVRQA
PGKGLEWVSW IYPSGGNTIY ADSVKGRFTI SRDNSKNTLY
LQMNSLRAED TATYYCARVG VWYGMDVWGQ GTTVTVSSAS
TKGPSVFPLA P

>HC-136-B06 (SEQ ID NO:830)
EVQLLESGGG LVQPGGSLRL SCAASGFTFS SYIMIWVRQA
PGKGLEWVSY IRPSGGYTKY ADSVKGRFTI SRDNSKNTLY
LQMNSLRAED TAVYYCARVI NAGPGRGYYW RGYSYSDAFD
IWGQGTMVTV SSASTKGPSV FPLAP

>HC-136-D07 (SEQ ID NO:836)
EVQLLESGGG LVQPGGSLRL SCAASGFTFS PYKMGWVRQA
PGKGLEWVSS IYPSGGVTTY ADSVKGRFTI SRDNSKNTLY
LQMNSLRAED TAVYYCTKNI NLRYDILTGY FDIWGQGTTV
TVSSASTKGP SVFPLAP

>HC-136-E10 (SEQ ID NO:847)
EVQLLESGGG LVQPGGSLRL SCAASGFTFS PYNMAWVRQA
PGKGLEWVSS IWPSGGRTRY ADSVKGRFTI SRDNSKNTLY
LQMNSLRAED TAVYYCAKGV RSSGLLERGR VYDAFDIWGQ
GTMVTVSSAS TKGPSVFPLA P

>HC-136-E12 (SEQ ID NO:848)
EVQLLESGGG LVQPGGSLRL SCAASGFTFS NYSMQWVRQA
PGKGLEWVSS IGPSGGRTWY ADSVKGRFTI SRDNSKNTLY
LQMNSLRAED TAVYYCARVG VWYGMDVWGQ GTTVTVSSAS
TKGPSVFPLA P

>HC-136-F08 (SEQ ID NO:858)
EVQLLESGGG LVQPGGSLRL SCAASGFTFS HYKMGWVRQA
PGKGLEWVSS IRPSGGATKY ADSVKGRFTI SRDNSKNTLY
LQMNSLRAED TAVYYCARVG IWDAFDIWGQ GAMVTVSSAS
TKGPSVFPLA P

>HC-137-B01 (SEQ ID NO:859)
EVQLLESGGG LVQPGGSLRL SCAASGFTFS YYRMTWVRQA
PGKGLEWVSS IYPSGGYTIY ADSVKGRFTI SRDNSKNTLY
LQMNSLRAED TAVYYCARLG QWLALDHWGQ GTLVTVSSAS
TKGPSVFPLA P

>HC-137-E01 (SEQ ID NO:860)
EVQLLESGGG LVQPGGSLRL SCAASGFTFS RYSMTWVRQA
PGKGLEWVSS IYPSGGKTTY ADSVKGRFTI SRDNSKNTLY
LQMNSLRAED TAVYYCASMV APYYYDSSGY PPAEYFQHWG
QGTLVTVSSA STKGPSVFPL AP

>HC-137-G10 (SEQ ID NO:866)
EVQLLESGGG LVQPGGSLRL SCAASGFTFS RYVMHWVRQA
PGKGLEWVSY ISPSGGVTKY ADSVKGRFTI SRDNSKNTLY
LQMNSLRAED TAVYYCAKAL YPGMGYYYGM DVWGQGTTVT
VSSASTKGPS VFPLAP

>HC-138-A03 (SEQ ID NO:876)
EVQLLESGGG LVQPGGSLRL SCAASGFTFS FYLMFWVRQA
PGKGLEWVSG IYPSGGQTVY ADSVKGRFTI SRDNSKNTLY
LQMNSLRAED TAVYYCARAI GAGSSFWGQG TLVTVSSAST
KGPSVFPLAP

>HC-138-B06 (SEQ ID NO:883)
EVQLLESGGG LVQPGGSLRL SCAASGFTFS PYTMSWVRQA
PGKGLEWVSG IYPSGGETWY ADSVKGRFTI SRDNSKNTLY
LQMNSLRAED TAVYYCAKNI NLRYDILTGY FDFWGQGTMV
TVSSASTKGP SVFPLAP

>HC-138-B10 (SEQ ID NO:884)
EVQLLESGGG LVQPGGSLRL SCAASGFTFS HYSMTWVRQA
PGKGLEWVSR IYPSGGRTGY ADSVKGRFTI SRDNSKNTLY
LQMNSLRAED TAVYYCATDS GGYYYGMDVW GQGTTVTVSS
ASTKGPSVFP LAP

>HC-138-C04 (SEQ ID NO:894)
EVQLLESGGG LVQPGGSLRL SCAASGFTFS HYHMQWVRQA
PGKGLEWVSG IRSSGGVTGY SDSVKGRFTI SRDNSKNTLY
LQMNSLRAED TAVYYCAREV TMVRGVYYYY YGMDVWGQGT
TVTVSSASTK GPSVFPLAP

>HC-138-C09 (SEQ ID NO:901)
EVQLLESGGG LVQPGGSLRL SCAASGFTFS PYRMSWVRQA
PGKGLEWVSI ISPSGGITEY ADSVKGRFTI SRDNSKNTLY
LQMNSLRAED TAVYYCAKHE RGSGYYVTPP AGAFDIWGQG
TMVTVSSAST KGPSVFPLAP

>HC-138-E02 (SEQ ID NO:902)
EVQLLESGGG LVQPGGSLRL SCAASGFTFS HYMMHWVRQA
PGKGLEWVSG IGPSGGKTPY ADSVKGRFTI SRDNSKNTLY
LQMNSLRAED TAVYYCARVG VWYGMDVWGQ GTTVTVSSAS
TKGPSVFPLA P

>HC-138-E12 (SEQ ID NO:918)
EVQLLESGGG LVQPGGSLRL SCAASGFTFS WYVMRWVRQA
PGKGLEWVSS IYPSGGQTRY ADSVKGRFTI SRDNSKNTLY
LQMNSLRAED TAMYYCATGY SSTWGAFDIW GQGTMVTVSS
ASTKGPSVFP LAP

>HC-138-G11 (SEQ ID NO:920)
EVQLLESGGG LVQPGGSLRL SCAASGFTFS WYTMTWVRQA
PGKGLEWVSS IYPSGGHTSY ADSVKGRFTI SRDNSKNTFY
LQMNSLRAED TAVYYCAKDT RVGPWLVRAP LDYWGQGTLV
TVSSASTKGP SVFPLAP

>HC-139-A04 (SEQ ID NO:950)
EVQLLESGGG LVQPGGSLRL SCAASGFTFS HYPMTWVRQA
PGKGLEWVSS IRPSGGNTGY ADSVKGRFTI SRDNSKNTLY
LQMNSLRAED TAVYYCARLT GYSSGWFWAY GMDVWGQGTT
VTVSSASTKG PSVFPLAP

>HC-139-A09 (SEQ ID NO:955)
EVQLLESGGG LVQPGGSLRL SCAASGFTFS WYFMVWVRQA
PGKGLEWVSG IGPSGGLTTY ADSVKGRFTI SRDNSKNTLY
LQMNSLRAED TAVYYCARSD WLNYWGQGTL VTVSSASTKG
PSVFPLAP
```

-continued

```
>HC-139-C02 (SEQ ID NO:962)
EVQLLESGGG LVQPGGSLRL SCAASGFTFS YYKMHWVRQA
PGKGLEWVSV IYPSGGKTTY ADSVKGRFTI SRDNSKNTLY
LQMNSLRAED TAVYYCTREH YQASYSSSAW FRMVPAGAFD
IWGQGTMVTV SSASTKGPSV FPLAP

>HC-139-E12 (SEQ ID NO:968)
EVQLLESGGG LVQPGGSLRL SCAASGFTFS WYSMNWVRQA
PGKGLEWVSS IGPSGGGTKY ADSVKGRFTI SRDNSKNTLY
LQMNSLRAED TAVYYCASRG QRKQWLPPNG AFDIWGQGTM
VTVSSASTKG PSVFPLAP

>HC-139-F04 (SEQ ID NO:974)
EVQLLESGGG LVQPGGSLRL SCAASGFTFS RYYMEWVRQA
PGKGLEWVSS ISSSGGSTEY ADSVKGRFTI SRDNSKNTLY
LQMNSLRAED TAVYYCAKDI TPGGGSGFRL PKNYYYYGMD
VWGQGTTVTV SSASTKGPSV FPLAP

>HC-139-F09 (SEQ ID NO:222)
EVQLLESGGG LVQPGGSLRL SCAASGFTFS HYVMAWVRQA
PGKGLEWVSR IGPSGGYTMY ADSVKGRFTI SRDNSKNTLY
LQMNSLRAED TAVYYCARVG VWYGMDVWGQ GTTVTVSSAS
TKGPSVFPLA P

>HC-135-H01 (SEQ ID NO:152)
EVQLLESGGG LVQPGGSLRL SCAASGFTFS AYLMAWVRQA
PGKGLEWVSS IRPSGGETRY ADSVKGRFTI SRDNSKNTLY
LQMNSLRAED TAVYYCTRDQ KGYPDSSSFR RYYYYYGMDV
WGQGTTVTVS SASTKGPSVF PLAP
```

Antibody 098-E09 has a LC variable domain that includes, at CDR1, the sequence TGTSSDIGAYNYVS (SEQ ID NO:1), at CDR2, the sequence DVSNRPS (SEQ ID NO:2), and, at CDR3, the sequence SSYRSSSLM (SEQ ID NO:3). It has a HC variable domain that includes, at CDR1, the sequence HYVMS (SEQ ID NO:4), at CDR2, the sequence YIYPSGGKTHYADSVKG (SEQ ID NO:5), and, at CDR3, the sequence VGVWYGMDV (SEQ ID NO:6).

Antibody 131-F07 has a LC variable domain that includes, at CDR1, the sequence RASQSISSYLN (SEQ ID NO:7), at CDR2, the sequence AASSLQS (SEQ ID NO:8), and, at CDR3, the sequence QQSYSTPLT (SEQ ID NO:9). It has a HC variable domain that includes, at CDR1, the sequence KYKMV (SEQ ID NO:10), at CDR2, the sequence SIYPSGGITAYADSVKG (SEQ ID NO:11), and, at CDR3, the sequence DITPGGGSGFRLPKNYYYYG-MDV (SEQ ID NO:12).

Antibody 139-F04 has a LC variable domain that includes, at CDR1,the sequence RASQGISSWLA (SEQ ID NO:13), at CDR2, the sequence AASSLER (SEQ ID NO:14), and, at CDR3, the sequence QQYHNFPLT (SEQ ID NO:15). It has a HC variable domain that includes, at CDR1, the sequence YYEME (SEQ ID NO:16), at CDR2, the sequence SIRPSGGRTVYADSVKG (SEQ ID NO:17), and, at CDR3, the sequence GRSNYYGSGSYSPKYFQH (SEQ ID NO:18).

Antibody 139-E12 has a LC variable domain that includes, at CDR1 the sequence RASQSVSSNYLS (SEQ ID NO:19), at CDR2, the sequence GTSNRAS (SEQ ID NO:20), and, at CDR3, the sequence QQYGGAPLFI (SEQ ID NO:21). It has a HC wariable domain that includes, at CDR1, the sequence HYNMN (SEQ ID NO:22), at CDR2, the sequence VIYPSGGQTHYADSVKG (SEQ ID NO:23), and, at CDR3, the sequence RGIWHSFDI (SEQ ID NO:24).

Antibody 097-F03 has a LC variable domain that includes, at CDR1, the sequence SGTNSNIGSNSVF (SEQ ID NO:25), at CDR2, the sequence RNSQRPS (SEQ ID NO:26), and, at CDR3, the sequence ATWDDSLRSPV (SEQ ID NO:27). It has a HC variable domain that includes, at CDR1, the sequence RYSMT (SEQ ID NO:28), at CDR2, the sequence SIYPSGGKTTYADSVKG (SEQ ID NO:29), and, at CDR3, the sequence MVAPYYYDSSGYPPAEY-FQH (SEQ ID NO:30).

Antibody 102-G12 has a LC variable domain that includes, at CDR1, the sequence RASQSISSYLN (SEQ ID NO:7), at CDR2, the sequence AASSLQS (SEQ ID NO:8), and, at CDR3, the sequence QQSYSTPRT (SEQ ID NO:33). It has a HC variable domain that includes, at CDR1, the sequence LYFMT (SEQ ID NO:34), at CDR2, the sequence SISSSGGSTKYADSVKG (SEQ ID NO:35), and, at CDR3, the sequence GGQWLAFDY (SEQ ID NO:36).

Antibody 102-E09 has a LC variable domain that includes, at CDR1, the sequence TGTSSDVGSYKLVS (SEQ ID NO:37), at CDR2, the sequence EGSKRPS (SEQ ID NO:38), and, at CDR3, the sequence CSYAGSSTWV (SEQ ID NO:39). It has a HC variable domain that includes, at CDR1, the sequence HYAMD (SEQ ID NO:40), at CDR2, the sequence VIYSSGGKTTYADSVKG (SEQ ID NO:41), and, at CDR3, the sequence VGVWYGMDV (SEQ ID NO:6).

Antibody 106-G12 has a LC variable domain that includes, at CDR1, the sequence RASQGISSWLA (SEQ ID NO:13), at CDR2, the sequence AASSLQS (SEQ ID NO:8), and, at CDR3, the sequence QQANSFPHT (SEQ ID NO:45). It has a HC variable domain that includes, at CDR1, the sequence FYLMF (SEQ ID NO:46), at CDR2, the sequence GIYPSGGQTVYADSVKG (SEQ ID NO:47), and, at CDR3, the sequence AIGAGSSF (SEQ ID NO:48).

Antibody 102-H11 has a LC variable domain that includes, at CDR1, the sequence RASRGISNWLA (SEQ ID NO:49), at CDR2, the sequence SASTLHA (SEQ ID NO:50), and, at CDR3, the sequence QEGNSFPYT (SEQ ID NO:51). It has a HC variable domain that includes, at CDR1, the sequence WYSMN (SEQ ID NO:52), at CDR2, the sequence SIGPSGGGTKYADSVKG (SEQ ID NO:53), and, at CDR3, the sequence RGQRKQWLPPNGAFDI (SEQ ID NO:54).

Antibody 138-C09 has a LC variable domain that includes, at CDR1, the sequence WTIYDISSWLA (SEQ ID NO:55), at CDR2, the sequence AASRLAT (SEQ ID NO:56), and, at CDR3, the sequence QQTKDFPLT (SEQ ID NO:57). It has a HC variable domain that includes, at CDR1, the sequence RYGMQ (SEQ ID NO:58), at CDR2, the sequence YIYPSGGGTVYADSVKG (SEQ ID NO:59), and, at CDR3, the sequence RVAVAGSWYYYYYGMDV (SEQ ID NO:60).

Antibody 098-G05 has a LC variable domain that includes, at CDR1, the sequence SGSSSNIGSNYVY (SEQ ID NO:61), at CDR2, the sequence RNNQRPS (SEQ ID NO:62), and, at CDR3, the sequence AAWDDSLSGVV (SEQ ID NO:63). It has a HC variable domain that includes, at CDR1, the sequence AYLMA (SEQ ID NO:64), at CDR2, the sequence SIRPSGGETRYADSVKG (SEQ ID NO:65), and, at CDR3, the sequence DQKGYPDSSSFR-RYYYYYGMDV (SEQ ID NO:66).

Antibody 136-E10 has a LC variable domain that includes, at CDR1, the sequence TGTNTDVGGYNLVS (SEQ ID NO:67), at CDR2, the sequence EVSNRPS (SEQ ID NO:68), and, at CDR3, the sequence GSYTSSSTHV (SEQ ID NO:69). It has a HC variable domain that includes, at CDR1, the sequence WYVMT (SEQ ID NO:70), at CDR2, the sequence VIYPSGGATKYADSVKG (SEQ ID NO:71), and, at CDR3, the sequence RGAGGMDV (SEQ ID NO:72).

Antibody 136-A07 has a LC variable domain that includes, at CDR1, the sequence RASHVINIDLG (SEQ ID NO:73), at CDR2, the sequence GASHLQR (SEQ ID NO:74), and, at CDR3, the sequence LQDSFYPRT (SEQ ID NO:75). It has a HC variable domain that includes, at CDR1, the sequence NYSMQ (SEQ ID NO:76), at CDR2, the sequence SIGPSGGRTWYADSVKG (SEQ ID NO:77), and, at CDR3, the sequence VGVWYGMDV (SEQ ID NO:6).

Antibody 097-G01 has a LC variable domain that includes, at CDR1, the sequence RASQDIASWLA (SEQ ID NO:79), at CDR2, the sequence AASSLQS (SEQ ID NO:8), and, at CDR3, the sequence QQANSFPFT (SEQ ID NO:81). It has a HC variable domain that includes, at CDR1, the sequence PYKMG (SEQ ID NO:82), at CDR2, the sequence SIYPSGGVTTYADSVKG (SEQ ID NO:83), and, at CDR3, the sequence NINLRYDILTGYFDI (SEQ ID NO:84).

Antibody 138-G11 has a LC variable domain that includes, at CDR1, the sequence RASQGISSWLV (SEQ ID NO:85), at CDR2, the sequence AASSLQS (SEQ ID NO:8), and, at CDR3, the sequence QQAKTFPLT (SEQ ID NO:87). It has a HC variable domain that includes, at CDR1, the sequence HYMMH (SEQ ID NO:88), at CDR2, the sequence GIGPSGGKTPYADSVKG (SEQ ID NO:89), and, at CDR3, the sequence VGVWYGMDV (SEQ ID NO:6).

Antibody 139-A09 has a LC variable domain that includes, at CDR1, the sequence RASQSVSSYLA (SEQ ID NO:91), at CDR2, the sequence DASNRAT (SEQ ID NO:92), and, at CDR3, the sequence QQRSNWLWT (SEQ ID NO:93). It has a HC variable domain that includes, at CDR1, the sequence HYVMQ (SEQ ID NO:94), at CDR2, the sequence GIGPSGGSTTYADSVKG (SEQ ID NO:95), and, at CDR3, the sequence VGVWYGMDV (SEQ ID NO:6).

Antibody 114-G06 has a LC variable domain that includes, at CDR1, the sequence TGTSSDVGAYNYVS (SEQ ID NO:97), at CDR2, the sequence EVNKRPS (SEQ ID NO:98), and, at CDR3, the sequence NSYAGSNSLI (SEQ ID NO:99). It has a HC variable domain that includes, at CDR1, the sequence HYSMF (SEQ ID NO:100), at CDR2, the sequence SIYPSGGQTDYADSVKG (SEQ ID NO:101), and, at CDR3, the sequence RGLLWSFDS (SEQ ID NO:102).

Antibody 139-C02 has a LC variable domain that includes, at CDR1, the sequence TGTSSDVGAYNYVS (SEQ ID NO:97), at CDR2, the sequence EVNKRPS (SEQ ID NO:98), and, at CDR3, the sequence NSYAGSNSLI (SEQ ID NO:99). It has a HC variable domain that includes, at CDR1, the sequence YYQMS (SEQ ID NO:106), at CDR2, the sequence RIGPSGGLTSYADSVKG (SEQ ID NO:107), and, at CDR3, the sequence VGVWYGMDV (SEQ ID NO:6).

Antibody 093-F09 has a LC variable domain that includes, at CDR1, the sequence RASQSVSSYLA (SEQ ID NO:91), at CDR2, the sequence DASNRAT (SEQ ID NO:92), and, at CDR3, the sequence QQRSNWPSPIA (SEQ ID NO:111). It has a HC variable domain that includes, at CDR1, the sequence HYVMI (SEQ ID NO:112), at CDR2, the sequence WIYPSGGNTIYADSVKG (SEQ ID NO:113), and, at CDR3, the sequence VGVWYGMDV (SEQ ID NO:6).

Antibody 110-F08 has a LC variable domain that includes, at CDR1, the sequence RASQGIRNDLG (SEQ ID NO:115), at CDR2, the sequence AASSLQS (SEQ ID NO:8), and, at CDR3, the sequence LQDYNYPRT (SEQ ID NO:117). It has a HC variable domain that includes, at CDR1, the sequence RYFMI (SEQ ID NO:118), at CDR2, the sequence SIVPSGGPTRYADSVKG (SEQ ID NO:119), and, at CDR3, the sequence RGPVYYYDSSGSHSAFDI (SEQ ID NO:120).

Antibody 117-F04 has a LC variable domain that includes, at CDR1, the sequence SGSNSNIGNNFVY (SEQ ID NO:121), at CDR2, the sequence RNNQRPS (SEQ ID NO:62), and, at CDR3, the sequence AAWDDSLSGVL (SEQ ID NO:123). It has a HC variable domain that includes, at CDR1, the sequence RYHMS (SEQ ID NO:124), at CDR2, the sequence SIRPSGGSTIYADSVKG (SEQ ID NO:125), and, at CDR3, the sequence EPRRYYYDSSGSYDAFDI (SEQ ID NO:126).

Antibody 111-D11 has a LC variable domain that includes, at CDR1, the sequence RASQSVSSYLA (SEQ ID NO:91), at CDR2, the sequence GASSRAT (SEQ ID NO:128), and, at CDR3, the sequence QQRGGWPLT (SEQ ID NO:129). It has a HC variable domain that includes, at CDR1, the sequence KYPMT (SEQ ID NO:130), at CDR2, the sequence SISSSGGKTQYADSVKG (SEQ ID NO:131), and, at CDR3, the sequence GGSTLYFMDV (SEQ ID NO:132).

Antibody 112-D07 has a LC variable domain that includes, at CDR1, the sequence SGSSSNIGSNYVH (SEQ ID NO:133), at CDR2, the sequence RNNRRPS (SEQ ID NO:134), and, at CDR3, the sequence AAWDDSLSGLVV (SEQ ID NO:135). It has a HC variable domain that includes, at CDR1, the sequence PYQMW (SEQ ID NO:136), at CDR2, the sequence SISSSGGLTRYADSVKG (SEQ ID NO:137), and, at CDR3, the sequence VKLNYYGSGSYSIDAFDI (SEQ ID NO:138).

Antibody 131-B05 has a LC variable domain that includes, at CDR1, the sequence RASQSISSYLN (SEQ ID NO:7), at CDR2, the sequence AASSLQS (SEQ ID NO:8), and, at CDR3, the sequence QQSYNAPWT (SEQ ID NO:141). It has a HC variable domain that includes, at CDR1, the sequence RYVMS (SEQ ID NO:142), at CDR2, the sequence SIRSSGGRTMYADSVKG (SEQ ID NO:143), and, at CDR3, the sequence VGVWYGMDV (SEQ ID NO:6).

Antibody 131-D01 has a LC variable domain that includes, at CDR1, the sequence TGTSSDVGAYNYVS (SEQ ID NO:97), at CDR2, the sequence DVSNRPS (SEQ ID NO:2), and, at CDR3, the sequence SSFRSRKTWV (SEQ ID NO:147). It has a HC variable domain that includes, at CDR1, the sequence FYAMV (SEQ ID NO:148), at CDR2, the sequence YISPSGGATWYADSVKG (SEQ ID NO:149), and, at CDR3, the sequence PSRPRYYYDSSGYYSSAFDI (SEQ ID NO:150).

Antibody 137-E01 has a LC variable domain that includes, at CDR1, the sequence RASQSVSSSYLA (SEQ ID NO:151), at CDR2, the sequence GASSRAT (SEQ ID NO:128), and, at CDR3, the sequence QQYGSSLT (SEQ ID NO:153). It has a HC variable domain that includes, at CDR1, the sequence HYSMT (SEQ ID NO:154), at CDR2, the sequence RIYPSGGRTGYADSVKG (SEQ ID NO:155), and, at CDR3, the sequence DSGGYYYGMDV (SEQ ID NO:156).

Antibody 132-C08 has a LC variable domain that includes, at CDR1, the sequence RASQSVSSSYLA (SEQ ID NO:157), at CDR2, the sequence GASSRAT (SEQ ID NO:128), and, at CDR3, the sequence QQSYRSPYT (SEQ ID NO:159). It has a HC variable domain that includes, at CDR1, the sequence HYVMA (SEQ ID NO:160), at CDR2, the sequence RIGPSGGYTMYADSVKG (SEQ ID NO:161), and, at CDR3, the sequence VGVWYGMDV (SEQ ID NO:6).

Antibody 114-G09 has a LC variable domain that includes, at CDR1, the sequence RASQSIGASLN (SEQ ID NO:163), at CDR2, the sequence TASNLQS (SEQ ID NO:164), and, at CDR3, the sequence QQNYRGRT (SEQ ID NO:165). It has a HC variable domain that includes, at CDR1, the sequence HYNMG (SEQ ID NO:166), at CDR2, the sequence RIGSSGGKTAYADSVKG (SEQ ID NO:167), and, at CDR3, the sequence TNYDFWSGYLPNPNPYPLDY (SEQ ID NO:168).

Antibody 138-A03 has a LC variable domain that includes, at CDR1, the sequence TGTSSDVNYVS (SEQ ID NO:169), at CDR2, the sequence AVTKRPS (SEQ ID NO:170), and, at CDR3, the sequence SSYAGSNNLV (SEQ ID NO:171). It has a HC variable domain that includes, at CDR1, the sequence HYPMD (SEQ ID NO:172), at CDR2, the sequence YIGPSGGSTRYADSVKG (SEQ ID NO:173), and, at CDR3, the sequence HVPPGT (SEQ ID NO:174).

Antibody 135-H01 has a LC variable domain that includes, at CDR1, the sequence TGTSSDVGAYNYVS (SEQ ID NO:97), at CDR2, the sequence DVSNRPS (SEQ ID NO:2), and, at CDR3, the sequence SSYTSSYTWV (SEQ ID NO:177). It has a HC variable domain that includes, at CDR1, the sequence HYHMQ (SEQ ID NO:178), at CDR2, the sequence SIRPSGGETRYADSVKG (SEQ ID NO:65), and, at CDR3, the sequence EVTMVRGVYYYYYGMDV (SEQ ID NO:180).

Antibody 108-D11 has a LC variable domain that includes, at CDR1, the sequence SGSSSNIGSNYVY (SEQ ID NO:181), at CDR2, the sequence RNNQRPS (SEQ ID NO:62), and, at CDR3, the sequence AAWDDSLSGHAV (SEQ ID NO:183). It has a HC variable domain that includes, at CDR1, the sequence HYQMH (SEQ ID NO:184), at CDR2, the sequence RIRSSGGATSYADSVKG (SEQ ID NO:185), and, at CDR3, the sequence GGGYSYYFDY (SEQ ID NO:186).

Antibody 136-E12 has a LC variable domain that includes, at CDR1, the sequence TGTSTDDVGGYNYVS (SEQ ID NO:187), at CDR2, the sequence DVINRPS (SEQ ID NO:188), and, at CDR3, the sequence SSYTSRGTRV (SEQ ID NO:189). It has a HC variable domain that includes, at CDR1, the sequence DYRMW (SEQ ID NO:190), at CDR2, the sequence YIVPSGGQTSYADSVKG (SEQ ID NO:191), and, at CDR3, the sequence GSAYQRRTYSSGWYSASGRRGTAEYFQH (SEQ ID NO:192).

Antibody 136-D07 has a LC variable domain that includes, at CDR1, the sequence RASQSISNWLA (SEQ ID NO:193), at CDR2, the sequence MASTLES (SEQ ID NO:194), and, at CDR3, the sequence QQYNSYSVT (SEQ ID NO:195). It has a HC variable domain that includes, at CDR1, the sequence HYLMY (SEQ ID NO:196), at CDR2, the sequence WIGPSGGHTMYADSVKG (SEQ ID NO:197), and, at CDR3, the sequence LQQGLDY (SEQ ID NO:198).

Antibody 138-E02 has a LC variable domain that includes, at CDR1, the sequence RASQSVSSNYLA (SEQ ID NO:199), at CDR2, the sequence YGASYRAT (SEQ ID NO:200), and, at CDR3, the sequence QQSYSTPWT (SEQ ID NO:201). It has a HC variable domain that includes, at CDR1, the sequence HYLMY (SEQ ID NO:202), at CDR2, the sequence RIYPSGGATSYADSVKG (SEQ ID NO:203), and, at CDR3, the sequence SGSWYSFDY (SEQ ID NO:204).

Antibody 13 1-F09 has a LC variable domain that includes, at CDR1, the sequence RASQGIGNYLV (SEQ ID NO:205), at CDR2, the sequence AASTLQS (SEQ ID NO:206), and, at CDR3, the sequence QKYDGAPFr (SEQ ID NO:207). It has a HC variable domain that includes, at CDR1, the sequence PYYMQ (SEQ ID NO:208), at CDR2, the sequence GISSSGGSTQYADSVKG (SEQ ID NO:209), and, at CDR3, the sequence SQRRTYYPNFGDAFDI (SEQ ID NO:210).

Antibody 134-B03 has a LC variable domain that includes, at CDR1, the sequence RASQSISSWLA (SEQ ID NO:211), at CDR2, the sequence KASSLES (SEQ ID NO:212), and, at CDR3, the sequence QQYNSYRYT (SEQ ID NO:213). It has a HC variable domain that includes, at CDR1, the sequence HYWMM (SEQ ID NO:214), at CDR2, the sequence WIGSSGGFTWYADSVKG (SEQ ID NO:215), and, at CDR3, the sequence GNGGFDS (SEQ ID NO:216).

Antibody 104-H12 has a LC variable domain that includes, at CDR1, the sequence SGTLSNIGTNIVS (SEQ ID NO:217), at CDR2, the sequence NDHRRPS (SEQ ID NO:218), and, at CDR3, the sequence AAWDDSLNGVV (SEQ ID NO:219). It has a HC variable domain that includes, at CDR1, the sequence KYKMV (SEQ ID NO:10), at CDR2, the sequence SIYPSGGITAYADSVKG (SEQ ID NO:11), and, at CDR3, the sequence DITPGGGSGFRLPKNYYYYGMDV (SEQ ID NO:12).

Antibody 135-F03 has a LC variable domain that includes, at CDR1, the sequence RSSQSLVYSDGNTYLN (SEQ ID NO:223), at CDR2, the sequence KVSNRDS (SEQ ID NO:224), and, at CDR3, the sequence MQGTHWQRLT (SEQ ID NO:225) It has a HC variable domain that includes, at CDR1, the sequence WYFMV (SEQ ID NO:226), at CDR2, the sequence GIGPSGGLTRYADSVKG (SEQ ID NO:227), and, at CDR3, the sequence SDWLNY (SEQ ID NO:228).

Antibody 134-D07 has a LC variable domain that includes, at CDR1, the sequence TGGRRDIGNYNYVS (SEQ ID NO:229), at CDR2, the sequence DVRKRPS (SEQ ID NO:230), and, at CDR3, the sequence GSYTGTSNV (SEQ ID NO:231). It has a HC variable domain that includes, at CDR1, the sequence HYVMS (SEQ ID NO:4), at CDR2, the sequence RIYPSGGQTYYADSVKG (SEQ ID NO:233), and, at CDR3, the sequence GAGWFDP (SEQ ID NO:234).

Antibody 135-C12 has a LC variable domain that includes, at CDR1, the sequence RASQSVGSDYLA (SEQ ID NO:235), at CDR2, the sequence AASTRAT (SEQ ID NO:236), and, at CDR3, the sequence QQYASPPRT (SEQ ID NO:237). It has a HC variable domain that includes, at CDR1, the sequence WYAMH (SEQ ID NO:238), at CDR2, the sequence WISPSGGQTKYADSVKG (SEQ ID NO:239), and, at CDR3, the sequence AKVLRYFDWLLGGDAFDI (SEQ ID NO:240).

Antibody 097-F04 has a LC variable domain that includes, at CDR1, the sequence RASQSVSFNLA (SEQ ID NO:241), at CDR2, the sequence FDASNRAT (SEQ ID NO:242), and, at CDR3, the sequence QQYGTSPFR (SEQ ID NO:243). It has a HC variable domain that includes, at CDR1, the sequence PYFME (SEQ ID NO:244), at CDR2, the sequence GISSSGGNTLYADSVKG (SEQ ID NO:245), and, at CDR3, the sequence DRFGNYYGSGSKLQHDAFDI (SEQ ID NO:246).

Antibody 111-C10 has a LC variable domain that includes, at CDR1, the sequence RASQTIRTYLN (SEQ ID NO:247), at CDR2, the sequence DASNLQT (SEQ ID NO:248), and, at CDR3, the sequence QQSYGGPPT (SEQ ID NO:249). It has a HC variable domain that includes, at CDR1, the sequence FYSMS (SEQ ID NO:250), at CDR2, the sequence RIRPSGGRTDYADSVKG (SEQ ID NO:251), and, at CDR3, the sequence DRLYYYGSGSYYYGAFDI (SEQ ID NO:252).

Antibody 094-E08 has a LC variable domain that includes, at CDR1, the sequence RASQSISTYLN (SEQ ID NO:253), at CDR2, the sequence AASSLQS (SEQ ID NO:8), and, at CDR3, the sequence QQYNSFPFS (SEQ ID NO:255). It has a HC variable domain that includes, at CDR1, the sequence HYLMD (SEQ ID NO:256), at CDR2, the sequence VIYPSGGHTNYADSVKG (SEQ ID NO:257), and, at CDR3, the sequence VGVWYGMDV (SEQ ID NO:6).

Antibody 138-B10 has a LC variable domain that includes, at CDR1, the sequence RASQSVSSSYLA (SEQ ID NO:259), at CDR2, the sequence DASNRAT (SEQ ID NO:92), and, at CDR3, the sequence QQWDT (SEQ ID NO:261). It has a HC variable domain that includes, at CDR1, the sequence HYKMG (SEQ ID NO:262), at CDR2, the sequence SIRPSGGATKYADSVKG (SEQ ID NO:263), and, at CDR3, the sequence VGIWDAFDI (SEQ ID NO:264).

Antibody 139-F09 has a LC variable domain that includes, at CDR1, the sequence RASQSISSYLN (SEQ ID NO:7), at CDR2, the sequence AASSLQS (SEQ ID NO:8), and, at CDR3, the sequence QQTYSTLFT (SEQ ID NO:267). It has a HC variable domain that includes, at CDR1, the sequence HYKME (SEQ ID NO:268), at CDR2, the sequence RIRPSGGVTKYADSVKG (SEQ ID NO:269), and, at CDR3, the sequence GGLWDAFDI (SEQ ID NO:270).

Antibody 104-A12 has a LC variable domain that includes, at CDR1, the sequence SGSSSNIGSNIVS (SEQ ID NO:271), at CDR2, the sequence SNNRRPS (SEQ ID NO:272), and, at CDR3, the sequence AAWDDSLNGHV (SEQ ID NO:273). It has a HC variable domain that includes, at CDR1, the sequence WYTMT (SEQ ID NO:274), at CDR2, the sequence SIYPSGGHTSYADS-VKG (SEQ ID NO:275), and, at CDR3, the sequence DTRVGPWLVRAPLDY (SEQ ID NO:276).

Antibody 132-D02 has a LC variable domain that includes, at CDR1, the sequence TGTSTDVGGYNYVS (SEQ ID NO:277), at CDR2, the sequence DVSNRPS (SEQ ID NO:2), and, at CDR3, the sequence SSYTNTITVV (SEQ ID NO:279). It has a HC variable domain that includes, at CDR1, the sequence HYLMY (SEQ ID NO:280), at CDR2, the sequence RIGPSGGWTKYADSVKG (SEQ ID NO:281), and, at CDR3, the sequence VGVWYGMDV (SEQ ID NO:6).

Antibody 138-C04 has a LC variable domain that includes, at CDR1, the sequence RASQSVSSSYLA (SEQ ID NO:283), at CDR2, the sequence GASSRAT (SEQ ID NO:128), and, at CDR3, the sequence QQYGSSPFT (SEQ ID NO:285). It has a HC variable domain that includes, at CDR1, the sequence HYLMH (SEQ ID NO:286), at CDR2, the sequence VIYPSGGTTKYADSVKG (SEQ ID NO:287), and, at CDR3, the sequence GNSGSHDY (SEQ ID NO:288).

Antibody 132-H11 has a LC variable domain that includes, at CDR1, the sequence RASQGIGNYLA (SEQ ID NO:289), at CDR2, the sequence KTSNLQS (SEQ ID NO:290), and, at CDR3, the sequence QRYDSYSQYI (SEQ ID NO:291). It has a HC variable domain that includes, at CDR1, the sequence MYVMN (SEQ ID NO:292), at CDR2, the sequence RIGSSGGGTLYADSVKG (SEQ ID NO:293), and, at CDR3, the sequence VSVYRIRNYYYYAMDV (SEQ ID NO:294).

Antibody 132-D08 has a LC variable domain that includes, at CDR1, the sequence RASQSVSGFLA (SEQ ID NO:295), at CDR2, the sequence DASNRAT (SEQ ID NO:92), and, at CDR3, the sequence QQYGDSSPIT (SEQ ID NO:297). It has a HC variable domain that includes, at CDR1, the sequence MYGMT (SEQ ID NO:298), at CDR2, the sequence GISPSGGRTYYADSVKG (SEQ ID NO:299), and, at CDR3, the sequence HRRDYVWWTYGMDV (SEQ ID NO:300).

Antibody 121-A07 has a LC variable domain that includes, at CDR1, the sequence RASQGISSWLA (SEQ ID NO:13), at CDR2, the sequence AASSLQS (SEQ ID NO:8), and, at CDR3, the sequence QQANSFPSLT (SEQ ID NO:303). It has a HC variable domain that includes, at CDR1, the sequence NYSMQ (SEQ ID NO:76), at CDR2, the sequence GIRPSGGSTRYADSVKG (SEQ ID NO:305), and, at CDR3, the sequence STGGYYYGMDV (SEQ ID NO:306).

Antibody 126-F11 has a LC variable domain that includes, at CDR1, the sequence RASQSVSSYLA (SEQ ID NO:91), at CDR2, the sequence DASNRAT (SEQ ID NO:92), and, at CDR3, the sequence QQRSNWPPYT (SEQ ID NO:309). It has a HC variable domain that includes, at CDR1, the sequence PYMMG (SEQ ID NO:310), at CDR2, the sequence SIRSSGGATAYADSVKG (SEQ ID NO:311), and, at CDR3, the sequence VGVWYGMDV (SEQ ID NO:6).

Antibody 098-H04 has a LC variable domain that includes, at CDR1, the sequence RASQAISTNLN (SEQ ID NO:313), at CDR2, the sequence AASSLQS (SEQ ID NO:8), and, at CDR3, the sequence QQTFSPPHT (SEQ ID NO:315). It has a HC variable domain that includes, at CDR1, the sequence RYYME (SEQ ID NO:316), at CDR2, the sequence SISSSGGSTEYADSVKG (SEQ ID NO:317), and, at CDR3, the sequence DITPGGGSGFRLP-KNYYYYGMDV (SEQ ID NO:12).

Antibody 093-C02 has a LC variable domain that includes, at CDR1, the sequence GASQSVSSSYLA (SEQ ID NO:319), at CDR2, the sequence DASSRAT (SEQ ID NO:320), and, at CDR3, the sequence LHDYNFPFT (SEQ ID NO:321). It has a HC variable domain that includes, at CDR1, the sequence HYPMI (SEQ ID NO:322), at CDR2, the sequence GIYSSGGTTKYADSVKG (SEQ ID NO:323), and, at CDR3, the sequence VGVWYGMDV (SEQ ID NO:6).

Antibody 115-G12 has a LC variable domain that includes, at CDR1, the sequence RASQAISNYLA (SEQ ID NO:325), at CDR2, the sequence AASTLQS (SEQ ID NO:326), and, at CDR3, the sequence QTYYSVPFT (SEQ ID NO:327). It has a HC variable domain that includes, at CDR1, the sequence IYAMI (SEQ ID NO:328), at CDR2, the sequence SIYSSGGPTQYADSVKG (SEQ ID NO:329), and, at CDR3, the sequence GRRTYYYDSS-GYYKYAAFDI (SEQ ID NO:330).

Antibody 135-B05 has a LC variable domain that includes, at CDR1, the sequence TGTSSDVGGYNYLS (SEQ ID NO:331), at CDR2, the sequence GVSNRPS (SEQ ID NO:332), and, at CDR3, the sequence SSYTSTGTRV (SEQ ID NO:333). It has a HC variable domain that includes, at CDR1, the sequence NYTMT (SEQ ID NO:334), at CDR2, the sequence VIYPSGGHTTYADS-VKG (SEQ ID NO:335), and, at CDR3, the sequence GGRWFSLDY (SEQ ID NO:336).

Antibody 136-F08 has a LC variable domain that includes, at CDR1, the sequence TGGRRDIGNYNYVS (SEQ ID NO:337), at CDR2, the sequence DVRKRPS (SEQ ID NO:338), and, at CDR3, the sequence GSYTGTSNV (SEQ ID NO:339). It has a HC variable domain that includes, at CDR1, the sequence HYVMQ (SEQ ID NO:94), at CDR2, the sequence SIYPSGGSTRYADSVKG (SEQ ID NO:341), and, at CDR3, the sequence FNVGFDL (SEQ ID NO:342).

Antibody 110-H11 has a LC variable domain that includes, at CDR1, the sequence RASQSISSYLN (SEQ ID NO:7), at CDR2, the sequence AASSLQS (SEQ ID NO:8), and, at CDR3, the sequence QQSYSTLYT (SEQ ID NO:345). It has a HC variable domain that includes, at CDR1, the sequence WYRMS (SEQ ID NO:346), at CDR2, the sequence SISPSGGPTKYADSVKG (SEQ ID NO:347), and, at CDR3, the sequence PSGDSSVYRPFAS (SEQ ID NO:348).

Antibody 110-D11 has a LC variable domain that includes, at CDR1, the sequence TDTSGNVGSYNLVS (SEQ ID NO:349), at CDR2, the sequence EVSRRPS (SEQ ID NO:350), and, at CDR3, the sequence CSYAGSNTYV (SEQ ID NO:351). It has a HC variable domain that includes, at CDR1, the sequence NYSMV (SEQ ID NO:352), at CDR2, the sequence RIYSSGGSTHYADSVKG (SEQ ID NO:353), and, at CDR3, the sequence VGVWYGMDV (SEQ ID NO:6).

Antibody 114-H07 has a LC variable domain that includes, at CDR1, the sequence SGGSSNIGSNRVN (SEQ ID NO:355), at CDR2, the sequence SNNQRPS (SEQ ID NO:356), and, at CDR3, the sequence AAWDDNLIGPV (SEQ ID NO:357). It has a HC variable domain that includes, at CDR1, the sequence WYHMY (SEQ ID NO:358), at CDR2, the sequence YIRPSGGNTNYADSVKG (SEQ ID NO:359), and, at CDR3, the sequence DRRGYSSSKGYYYYGMDV (SEQ ID NO:360).

Antibody 098-E01 has a LC variable domain that includes, at CDR1, the sequence SGSSSNIGSNYVY (SEQ ID NO:361), at CDR2, the sequence RNNQRPS (SEQ ID NO:122), and, at CDR3, the sequence AAWDDSMSGVV (SEQ ID NO:363). It has a HC variable domain that includes, at CDR1, the sequence HYFMH (SEQ ID NO:364), at CDR2, the sequence YISSSGGLTGYADSVKG (SEQ ID NO:365), and, at CDR3, the sequence RGPVYYYDSSGSHSAFDI (SEQ ID NO:120).

Antibody 135-C11 has a LC variable domain that includes, at CDR1, the sequence TGSTSDVGGYTYVS (SEQ ID NO:367), at CDR2, the sequence DVSKRPS (SEQ ID NO:368), and, at CDR3, the sequence CSYAGSYSYV (SEQ ID NO:369). It has a HC variable domain that includes, at CDR1, the sequence NYHMD (SEQ ID NO:370), at CDR2, the sequence VIGPSGGFTRYADSVKG (SEQ ID NO:371), and, at CDR3, the sequence ALGGSLDY (SEQ ID NO:372).

Antibody 095-A11 has a LC variable domain that includes, at CDR1, the sequence TATSSDLGSYNFVS (SEQ ID NO:373), at CDR2, the sequence EVSRRPS (SEQ ID NO:374), and, at CDR3, the sequence CSYAGSNTYV (SEQ ID NO:375). It has a HC variable domain that includes, at CDR1, the sequence NYSMM (SEQ ID NO:376), at CDR2, the sequence SIYPSGGFTKYADSVKG (SEQ ID NO:377), and, at CDR3, the sequence VGFYGGFV (SEQ ID NO:378).

Antibody 092-F08 has a LC variable domain that includes, at CDR1, the sequence RASQSISSWLA (SEQ ID NO:379), at CDR2, the sequence KASSLGS (SEQ ID NO:380), and, at CDR3, the sequence QQYYSYSQT (SEQ ID NO:381). It has a HC variable domain that includes, at CDR1, the sequence NYPMH (SEQ ID NO:382), at CDR2, the sequence YIGPSGGWTRYADSVKG (SEQ ID NO:383), and, at CDR3, the sequence APSGY (SEQ ID NO:384).

Antibody 104-B12 has a LC variable domain that includes, at CDR1, the sequence TGTSSDVGLYNFVS (SEQ ID NO:385), at CDR2, the sequence DVSRRPS (SEQ ID NO:386), and, at CDR3, the sequence SSYAGSNNYV (SEQ ID NO:387). It has a HC variable domain that includes, at CDR1, the sequence PYRMS (SEQ ID NO:388), at CDR2, the sequence VISPSGGITEYADSVKG (SEQ ID NO:389), and, at CDR3, the sequence HERGSGYYVTPPAGAFDI (SEQ ID NO:390).

Antibody 109-A11 has a LC variable domain that includes, at CDR1, the sequence RASQSIANYLN (SEQ ID NO:391), at CDR2, the sequence AASRLHS (SEQ ID NO:392), and, at CDR3, the sequence QQSHASPLT (SEQ ID NO:393). It has a HC variable domain that includes, at CDR1, the sequence HYAMG (SEQ ID NO:394), at CDR2, the sequence RIWPSGGHTQYADSVKG (SEQ ID NO:395), and, at CDR3, the sequence GYSSTWGAFDI (SEQ ID NO:396).

Antibody 131-G03 has a LC variable domain that includes, at CDR1, the sequence TGTSSDVGGYNYVS (SEQ ID NO:397), at CDR2, the sequence EVSNRPS (SEQ ID NO:68), and, at CDR3, the sequence SSYKRGGTYV (SEQ ID NO:399). It has a HC variable domain that includes, at CDR1, the sequence WYGMG (SEQ ID NO:400), at CDR2, the sequence VIRPSGGTTRYADSVKG (SEQ ID NO:401), and, at CDR3, the sequence GGRYYSLDY (SEQ ID NO:402).

Antibody 135-E10 has a LC variable domain that includes, at CDR1, the sequence RASQSVTTFLA (SEQ ID NO:403), at CDR2, the sequence GASSRAA (SEQ ID NO:404), and, at CDR3, the sequence QQYRFSPPT (SEQ ID NO:405). It has a HC variable domain that includes, at CDR1, the sequence PYNMA (SEQ ID NO:406), at CDR2, the sequence SIWPSGGRTRYADSVKG (SEQ ID NO:407), and, at CDR3, the sequence GVRSSGLLERGRVYDAFDI (SEQ ID NO:408).

Antibody 130-B02 has a LC variable domain that includes, at CDR1, the sequence RASQSVSGSYLA (SEQ ID NO:409), at CDR2, the sequence GAYSRAT (SEQ ID NO:410), and, at CDR3, the sequence QHYGSSPRT (SEQ ID NO:411). It has a HC variable domain that includes, at CDR1, the sequence HYQMH (SEQ ID NO-412), at CDR2, the sequence SIRPSGGRTAYADSVKG (SEQ ID NO:413), and, at CDR3, the sequence VGVWYGMDV (SEQ ID NO:6).

Antibody 097-D04 has a LC variable domain that includes, at CDR1, the sequence RAGQNIYYWLA (SEQ ID NO:415), at CDR2, the sequence AASSLQS (SEQ ID NO:8), and, at CDR3, the sequence QQAKSFPVT (SEQ ID NO:417). It has a HC variable domain that includes, at CDR1, the sequence PYIMS (SEQ ID NO:418), at CDR2, the sequence SIVSSGGVTLYADSVKG (SEQ ID NO:419), and, at CDR3, the sequence NINLRYDILTGYFDI (SEQ ID NO:84).

Antibody 093-G06 has a LC variable domain that includes, at CDR1, the sequence SGTSSDVGAYYHVS (SEQ ID NO:421), at CDR2, the sequence EVTNRPS (SEQ ID NO:422), and, at CDR3, the sequence SSYTTSNTLV (SEQ ID NO:423). It has a HC variable domain that includes, at CDR1, the sequence WYVMR (SEQ ID NO:424), at CDR2, the sequence SIYPSGGQTRYADSVKG (SEQ ID NO:425), and, at CDR3, the sequence GYSSTWGAFDI (SEQ ID NO:396).

Antibody 108-E11 has a LC variable domain that includes, at CDR1, the sequence RASQSVSSNLA (SEQ ID NO:427), at CDR2, the sequence GASTRAT (SEQ ID NO:428), and, at CDR3, the sequence QQNNNWPPSFT (SEQ ID NO:429). It has a HC variable domain that includes, at CDR1, the sequence HYTML (SEQ ID NO:430), at CDR2, the sequence SIYSSGGSTYYADS-VKG (SEQ ID NO:431), and, at CDR3, the sequence VGVWYGMDV (SEQ ID NO:6).

Antibody 127-C06 has a LC variable domain that includes, at CDR1, the sequence RASQSVSSSYLA (SEQ ID NO:433), at CDR2, the sequence GASSRAT (SEQ ID NO:128), and, at CDR3, the sequence QQYGSSRYT (SEQ ID NO:435). It has a HC variable domain that includes, at CDR1, the sequence NYTMF (SEQ ID NO:436), at CDR2, the sequence SIYPSGGITRYADSVKG (SEQ ID NO:437), and, at CDR3, the sequence VSFWNAFDI (SEQ ID NO:438).

Antibody 105-B06 has a LC variable domain that includes, at CDR1, the sequence RASQTISSYLN (SEQ ID NO:439), at CDR2, the sequence TTSSLQS (SEQ ID NO:440), and, at CDR3, the sequence QQSHSSPT (SEQ ID NO:441). It has a HC variable domain that includes, at CDR1, the sequence HYLMY (SEQ ID NO:442), at CDR2, the sequence SIYPSGGFTAYADSVKG (SEQ ID NO:443), and, at CDR3, the sequence RGVYGTFDI (SEQ ID NO:444).

Antibody 107-D01 has a LC variable domain that includes, at CDR1, the sequence RASQDVRRFLA (SEQ ID NO:445), at CDR2, the sequence AASSLQS (SEQ ID NO:8), and, at CDR3, the sequence QQANSFPIT (SEQ ID NO:447). It has a HC variable domain that includes, at CDR1, the sequence HYPMS (SEQ ID NO:448), at CDR2, the sequence YIRSGGYTTYADSVKG (SEQ ID NO:449), and, at CDR3, the sequence ERVFCSGGRCGSYFDY (SEQ ID NO:450).

Antibody 107-F11 has a LC variable domain that includes, at CDR1, the sequence RASQSVYSSYLA (SEQ ID NO:451), at CDR2, the sequence AASNR (SEQ ID NO:452), and, at CDR3, the sequence QQSYSTPR (SEQ ID NO:453). It has a HC variable domain that includes, at CDR1, the sequence RYAMF (SEQ ID NO:454), at CDR2, the sequence SISPSGGKTRYADSVKG (SEQ ID NO:455), and, at CDR3, the sequence GGGTALDY (SEQ ID NO:456).

Antibody 101-E01 has a LC variable domain that includes, at CDR1, the sequence RASQSISSWLA (SEQ ID NO:457), at CDR2, the sequence AASSLRN (SEQ ID NO:458), and, at CDR3, the sequence QQSYSTPPT (SEQ ID NO:459). It has a HC variable domain that includes, at CDR1, the sequence RYWMA (SEQ ID NO:460), at CDR2, the sequence SIGPSGGSTKYADSVKG (SEQ ID NO:461), and, at CDR3, the sequence TARWLSFDY (SEQ ID NO:462).

Antibody 138-E12 has a LC variable domain that includes, at CDR1, the sequence RASQSVSSNYLA (SEQ ID NO:463), at CDR2, the sequence GASSRAT (SEQ ID NO:128), and, at CDR3, the sequence QQFGSSLFT (SEQ ID NO:465). It has a HC variable domain that includes, at CDR1, the sequence NYYML (SEQ ID NO:466), at CDR2, the sequence YIRSSGGSTRYADSVKG (SEQ ID NO:467), and, at CDR3, the sequence PTVDGAFDY (SEQ ID NO:468).

Antibody 109-E08 has a LC variable domain that includes, at CDR1, the sequence AGTSSDLGGYDYVS (SEQ ID NO:469), at CDR2, the sequence QVGRRPS (SEQ ID NO:470), and, at CDR3, the sequence SSYTSSRTRV (SEQ ID NO:471). It has a HC variable domain that includes, at CDR1, the sequence HYVMD (SEQ ID NO:472), at CDR2, the sequence SIYPSGGWTRYADS-VKG (SEQ ID NO:473), and, at CDR3, the sequence RGQWLVLDY (SEQ ID NO:474).

Antibody 104-B03 has a LC variable domain that includes, at CDR1, the sequence TGTSSDVGGFNYVS (SEQ ID NO:475), at CDR2, the sequence DVSKRPS (SEQ ID NO:476), and, at CDR3, the sequence CSYTGNYTYV (SEQ ID NO:477). It has a HC variable domain that includes, at CDR1, the sequence RYAMA (SEQ ID NO:478), at CDR2, the sequence SIGSSGGVTKYADS-VKG (SEQ ID NO:479), and, at CDR3, the sequence PRGRYYYDSSGYYYGGVFDY (SEQ ID NO:480).

Antibody 096-E11 has a LC variable domain that includes, at CDR1, the sequence RASQGISNYLA (SEQ ID NO:481), at CDR2, the sequence AASTLQS (SEQ ID NO:482), and, at CDR3, the sequence QQSYSTPYT (SEQ ID NO:483). It has a HC variable domain that includes, at CDR1, the sequence QYLMA (SEQ ID NO:484), at CDR2, the sequence SIYPSGGNTNYADSVKG (SEQ ID NO:485), and, at CDR3, the sequence DRSIVPYSSSWYM-PRDYYYGMDV (SEQ ID NO:486).

Antibody 103-A03 has a LC variable domain that includes, at CDR1, the sequence RASQSVSSSYLA (SEQ ID NO:487), at CDR2, the sequence GAASRAT (SEQ ID NO:488), and, at CDR3, the sequence QQYGSSPLIT (SEQ ID NO:489). It has a HC variable domain that includes, at CDR1, the sequence HYPMT (SEQ ID NO:490), at CDR2, the sequence SIRPSGGNTGYADSVKG (SEQ ID NO:491), and, at CDR3, the sequence LTGYSSGWFWAYGMDV (SEQ ID NO:492).

Antibody 099-A09 has a LC variable domain that includes, at CDR1, the sequence TGTSSDVGGYNYVS (SEQ ID NO:493), at CDR2, the sequence EVSNRAS (SEQ ID NO:494), and, at CDR3, the sequence SSYTSSTTLL (SEQ ID NO:495). It has a HC variable domain that includes, at CDR1, the sequence RYVMA (SEQ ID NO:496), at CDR2, the sequence VIRPSGGKTLYADS-VKG (SEQ ID NO:497), and, at CDR3, the sequence VAGRVGVPATKKNWFDP (SEQ ID NO:498).

Antibody 105-F02 has a LC variable domain that includes, at CDR1, the sequence RASQGISSWLA (SEQ ID NO:13), at CDR2, the sequence AASSLQS (SEQ ID NO:8), and, at CDR3, the sequence QQANSFPLT (SEQ ID NO:501). It has a HC variable domain that includes, at CDR1, the sequence PYTMS (SEQ ID NO:502), at CDR2, the sequence GIYPSGGETWYADSVKG (SEQ ID NO:503), and, at CDR3, the sequence NINLRYDILTGY-FDF (SEQ ID NO:504).

Antibody 112-C02 has a LC variable domain that includes, at CDR1, the sequence RASQSVSSSYLA (SEQ ID NO:505), at CDR2, the sequence GASSRAT (SEQ ID NO:128), and, at CDR3, the sequence QQYGSSGWT (SEQ ID NO:507). It has a HC variable domain that includes, at CDR1, the sequence YYRMT (SEQ ID NO:508), at CDR2, the sequence SIYPSGGYTIYADSVKG (SEQ ID NO:509), and, at CDR3, the sequence LGQWLALDH (SEQ ID NO:510).

Antibody 125-C04 has a LC variable domain that includes, at CDR1, the sequence QGDSLRSYYAS (SEQ ID NO:51 1), at CDR2, the sequence SKSNRPS (SEQ ID NO:512), and, at CDR3, the sequence NSRDSSGNHLV (SEQ ID NO:513). It has a HC variable domain that includes, at CDR1, the sequence KYWMA (SEQ ID NO:514), at CDR2, the sequence VIYPSGGQTKYADS-VKG (SEQ ID NO:515), and, at CDR3, the sequence MRYGDRFDY (SEQ ID NO:516).

Antibody 122-H04 has a LC variable domain that includes, at CDR1, the sequence RASQGISSYLA (SEQ ID NO:517), at CDR2, the sequence AASTLQS (SEQ ID NO:518), and, at CDR3, the sequence QQLNSYPRT (SEQ ID NO:519). It has a HC variable domain that includes, at CDR1, the sequence RYWMH (SEQ ID NO:520), at CDR2, the sequence SIGPSGGVTKYADSVKG (SEQ ID NO:521), and, at CDR3, the sequence HGSWGGMDV (SEQ ID NO:522).

Antibody 092-B 12 has a LC variable domain that includes, at CDR1, the sequence TGTTSDVGGYKYVS (SEQ ID NO:523), at CDR2, the sequence EVNHRPS (SEQ ID NO:524), and, at CDR3, the sequence YSYTSDSTPYV (SEQ ID NO:525). It has a HC variable domain that includes, at CDR1, the sequence RYAMH (SEQ ID NO:526), at CDR2, the sequence SIWPSGGATFYADSVKG (SEQ ID NO:527), and, at CDR3, the sequence SPTLNAFHI (SEQ ID NO:528).

Antibody 139-A04 has a LC variable domain that includes, at CDR1, the sequence RASQSISNWLA (SEQ ID NO:529), at CDR2, the sequence KASTLES (SEQ ID NO:530), and, at CDR3, the sequence QHYNSYSL (SEQ ID NO:531). It has a HC variable domain that includes, at CDR1, the sequence HYTMV (SEQ ID NO:532), at CDR2, the sequence SIYSSGGRTNYADSVKG (SEQ ID NO:533), and, at CDR3, the sequence IVVVPSAQFYFYYGMDV (SEQ ID NO:534).

Antibody 108-C10 has a LC variable domain that includes, at CDR1, the sequence TGTSNDIGRTNYVS (SEQ ID NO:535), at CDR2, the sequence EVSNRPS (SEQ ID NO:68), and, at CDR3, the sequence SSCTTAPVCV (SEQ ID NO:537). It has a HC variable domain that includes, at CDR1, the sequence LYAMH (SEQ ID NO:538), at CDR2, the sequence SIRPSGGLTKYADSVKG (SEQ ID NO:539), and, at CDR3, the sequence VGVWYGMDV (SEQ ID NO:6).

Antibody 138-B06 has a LC variable domain that includes, at CDR1, the sequence SGSSSNIGSNYVY (SEQ ID NO:541), at CDR2, the sequence SNNQRPS (SEQ ID NO:542), and, at CDR3, the sequence ATWDNSLSAWV (SEQ ID NO:543). It has a HC variable domain that includes, at CDR1, the sequence HYVMN (SEQ ID NO:544), at CDR2, the sequence RIYPSGGVTVYADSVKG (SEQ ID NO:545), and, at CDR3, the sequence GYGMDV (SEQ ID NO:546).

Antibody 137-B01 has a LC variable domain that includes, at CDR1, the sequence RASQSVGNSLA (SEQ ID NO:547), at CDR2, the sequence GASTRAS (SEQ ID NO:548), and, at CDR3, the sequence QEYNKWPIT (SEQ ID NO:549). It has a HC variable domain that includes, at CDR1, the sequence WYWMY (SEQ ID NO:550), at CDR2, the sequence VIGSSGGVTKYADSVKG (SEQ ID NO:551), and, at CDR3, the sequence GPYRGYFDY (SEQ ID NO:552).

Antibody 111-B02 has a LC variable domain that includes, at CDR1, the sequence RASQSISSYLS (SEQ ID NO:553), at CDR2, the sequence SASNLQS (SEQ ID NO:554), and, at CDR3, the sequence QQIYRTPLT (SEQ ID NO:555). It has a HC variable domain that includes, at CDR1, the sequence WYQMM (SEQ ID NO:556), at CDR2, the sequence SYIRSSGGKTDYADSVKG (SEQ ID NO:557), and, at CDR3, the sequence VGVWYGMDV (SEQ ID NO:6).

Antibody 129-B09 has a LC variable domain that includes, at CDR1, the sequence RASQSVGSDYLA (SEQ ID NO:559), at CDR2, the sequence GASSRAT (SEQ ID NO:128), and, at CDR3, the sequence QQYGSSLYT (SEQ ID NO:561). It has a HC variable domain that includes, at CDR1, the sequence NYKMS (SEQ ID NO:562), at CDR2, the sequence GIYPSGGLTQYADSVKG (SEQ ID NO:563), and, at CDR3, the sequence VGVWYGMDV (SEQ ID NO:6).

Antibody 099-C12 has a LC variable domain that includes, at CDR1, the sequence RAGQTINNYLN (SEQ ID NO:565), at CDR2, the sequence AASNLQS (SEQ ID NO:566), and, at CDR3, the sequence QQTYRTPFT (SEQ ID NO:567). It has a HC variable domain that includes, at CDR1, the sequence HYKMH (SEQ ID NO:568), at CDR2, the sequence SIWPSGGGTFYADSVKG (SEQ ID NO:569), and, at CDR3, the sequence TSGGFGAFDI (SEQ ID NO:570).

Antibody 099-E11 has a LC variable domain that includes, at CDR1, the sequence RASQSISSYLN (SEQ ID NO:7), at CDR2, the sequence AASSLQS (SEQ ID NO:8), and, at CDR3, the sequence QQSYSTPRT (SEQ ID NO:573). It has a HC variable domain that includes, at CDR1, the sequence HYYMM (SEQ ID NO:574), at CDR2, the sequence SIGPSGGMTDYADSVKG (SEQ ID NO:575), and, at CDR3, the sequence GGTASLDY (SEQ ID NO:576).

Antibody 103-F07 has a LC variable domain that includes, at CDR1, the sequence RASQSVSSSYLA (SEQ ID NO:577), at CDR2, the sequence GASSRAT (SEQ ID NO:128), and, at CDR3, the sequence QQYGSSSYT (SEQ ID NO:579). It has a HC variable domain that includes, at CDR1, the sequence HYVMG (SEQ ID NO:580), at CDR2, the sequence SIYPSGGKTTYADSVKG (SEQ ID NO:581), and, at CDR3, the sequence PSTGSWSAFDI (SEQ ID NO:582).

Antibody 102-A04 has a LC variable domain that includes, at CDR1, the sequence TGTSSDVGGYNYVS (SEQ ID NO:583), at CDR2, the sequence DVSKRPS (SEQ ID NO:584), and, at CDR3, the sequence SSYTSSITLVV (SEQ ID NO:585). It has a HC variable domain that includes, at CDR1, the sequence WYAMH (SEQ ID NO:586), at CDR2, the sequence VISPSGGATRYADSVKG (SEQ ID NO:587), and, at CDR3, the sequence ASTVTTLFQH (SEQ ID NO:588).

Antibody 119-B09 has a LC variable domain that includes, at CDR1, the sequence RASQSISSWLA (SEQ ID NO:589), at CDR2, the sequence AASTLQS (SEQ ID NO:590), and, at CDR3, the sequence QKYNSAPLT (SEQ ID NO:591). It has a HC variable domain that includes, at CDR1, the sequence NYHMQ (SEQ ID NO:592), at CDR2, the sequence SIYPSGGFTRYADSVKG (SEQ ID NO:593), and, at CDR3, the sequence DGGQGG (SEQ ID NO:594).

Antibody 097-E07 has a LC variable domain that includes, at CDR1, the sequence RASQSISSYLN (SEQ ID NO:7), at CDR2, the sequence AASSLQS (SEQ ID NO:8), and, at CDR3, the sequence QQTFSTWT (SEQ ID NO:597). It has a HC variable domain that includes, at CDR1, the sequence HYLMG (SEQ ID NO:598), at CDR2, the sequence SIWPSGGHTSYADSVKG (SEQ ID NO:599), and, at CDR3, the sequence HYGMDV (SEQ ID NO:600).

Antibody 117-A12 has a LC variable domain that includes, at CDR1, the sequence RASQSVSSSYLA (SEQ ID NO:601), at CDR2, the sequence GASSRAT (SEQ ID NO:128), and, at CDR3, the sequence QQYNNWPPLT (SEQ ID NO:603). It has a HC variable domain that includes, at CDR1, the sequence RYMMY (SEQ ID NO:604), at CDR2, the sequence SIYPSGGKTLYADSVKG (SEQ ID NO:605), and, at CDR3, the sequence VGVWYGMDV (SEQ ID NO:6).

Antibody 126-C10 has a LC variable domain that includes, at CDR1, the sequence RASHNIYTSLN (SEQ ID NO:607), at CDR2, the sequence GASTLEN (SEQ ID NO:608), and, at CDR3, the sequence QQSYTSVT (SEQ ID NO:609). It has a HC variable domain that includes, at CDR1, the sequence FYSMM (SEQ ID NO:610), at CDR2, the sequence GISSSGGTTKYADSVKG (SEQ ID NO:611), and, at CDR3, the sequence GGTNYDYVWGSYRSHYYYYGMDV (SEQ ID NO:612).

Antibody 127-D05 has a LC variable domain that includes, at CDR1, the sequence RASQSISSWLA (SEQ ID NO:613), at CDR2, the sequence TASSLES (SEQ ID NO:614), and, at CDR3, the sequence QQYNSYSLT (SEQ ID NO:615). It has a HC variable domain that includes, at CDR1, the sequence NYKMQ (SEQ ID NO:616), at CDR2, the sequence SIYSSGGKTVYADSVKG (SEQ ID NO:617), and, at CDR3, the sequence TPGYNYFDY (SEQ ID NO:618).

Antibody 126-B12 has a LC variable domain that includes, at CDR1, the sequence RASQTFNNYLN (SEQ ID NO:619), at CDR2, the sequence AASTLQS (SEQ ID NO:620), and, at CDR3, the sequence QQANSFPFT (SEQ ID NO:81). It has a HC variable domain that includes, at CDR1, the sequence HYLMF (SEQ ID NO:622), at CDR2, the sequence SIWPSGGNTKYADSVKG (SEQ ID NO:623), and, at CDR3, the sequence PAYYYAMDV (SEQ ID NO:624).

Antibody 122-G06 has a LC variable domain that includes, at CDR1, the sequence RASQTVGGSYLA (SEQ ID NO:625), at CDR2, the sequence AASNRAP (SEQ ID NO:626), and, at CDR3, the sequence QQYGSSMYT (SEQ ID NO:627). It has a HC variable domain that includes, at CDR1, the sequence WYQMS (SEQ ID NO:628), at CDR2, the sequence SIYPSGGATKYADSVKG (SEQ ID NO:629), and, at CDR3, the sequence MGLHHSFDY (SEQ ID NO:630).

Antibody 107-D05 has a LC variable domain that includes, at CDR1, the sequence RASQGISSWLA (SEQ ID NO:13), at CDR2, the sequence AASSLQS (SEQ ID NO:8), and, at CDR3, the sequence QQANSFPLT (SEQ ID NO:633). It has a HC variable domain that includes, at CDR1, the sequence HYWMR (SEQ ID NO:634), at CDR2, the sequence SIGSSGGMTKYADSVKG (SEQ ID NO:635), and, at CDR3, the sequence ALRWRAFDI (SEQ ID NO:636).

Antibody 127-H05 has a LC variable domain that includes, at CDR1, the sequence TGTNTDVGGYNYVS (SEQ ID NO:637), at CDR2, the sequence EVNHRPS (SEQ ID NO:638), and, at CDR3, the sequence SSYTYRNTYV (SEQ ID NO:639). It has a HC variable domain that includes, at CDR1, the sequence WYTMG (SEQ ID NO:640), at CDR2, the sequence VIYPSGGMTKYADSVKG (SEQ ID NO:641), and, at CDR3, the sequence TSGGTPWGF (SEQ ID NO:642).

Antibody 112-C12 has a LC variable domain that includes, at CDR1, the sequence RASQTVSSNYLA (SEQ ID NO:643), at CDR2, the sequence GVSNRAA (SEQ ID NO:644), and, at CDR3, the sequence QHYGSSAFT (SEQ ID NO:645). It has a HC variable domain that includes, at CDR1, the sequence NYIMS (SEQ ID NO:646), at CDR2, the sequence SIWPSGGHTRYADSVKG (SEQ ID NO:647), and, at CDR3, the sequence AGSYYAGDY (SEQ ID NO:648).

Antibody 098-C10 has a LC variable domain that includes, at CDR1, the sequence RASQDVLVSFA (SEQ ID NO:649), at CDR2, the sequence AASHLHP (SEQ ID NO:650), and, at CDR3, the sequence QQARSFPHT (SEQ ID NO:651). It has a HC variable domain that includes, at CDR1, the sequence WYSMI (SEQ ID NO:652), at CDR2, the sequence SISPSGGATKYADSVKG (SEQ ID NO:653), and, at CDR3, the sequence GGAASLPFDY (SEQ ID NO:654).

Antibody 095-H10 has a LC variable domain that includes, at CDR1, the sequence FGDKLGDKYGS (SEQ ID NO:655), at CDR2, the sequence QYWKRPS (SEQ ID NO:656), and, at CDR3, the sequence QAWDSNTVV (SEQ ID NO:657). It has a HC variable domain that includes, at CDR1, the sequence NYKMH (SEQ ID NO:658), at CDR2, the sequence SIYPSGGWTVYADSVKG (SEQ ID NO:659), and, at CDR3, the sequence (SEQ ID NO:396).

Antibody 117-C04 has a LC variable domain that includes, at CDR1, the sequence RASQYISTYLA (SEQ ID NO:661), at CDR2, the sequence KASDLES (SEQ ID NO:662), and, at CDR3, the sequence QQYNTYWT (SEQ ID NO:663). It has a HC variable domain that includes, at CDR1, the sequence FYVMG (SEQ ID NO:664), at CDR2, the sequence WIGPSGGRTWYADSVKG (SEQ ID NO:665), and, at CDR3, the sequence DRGWYGIDV (SEQ ID NO:666).

Antibody 094-F03 has a LC variable domain that includes, at CDR1, the sequence SGNILDNSYAS (SEQ ID NO:667), at CDR2, the sequence RDNKRPS (SEQ ID NO:668), and, at CDR3, the sequence QAWDRTTGV (SEQ ID NO:669). It has a HC variable domain that includes, at CDR1, the sequence WYNMY (SEQ ID NO:670), at CDR2, the sequence YIVPSGGATHYADSVKG (SEQ ID NO:671), and, at CDR3, the sequence ALRGYSYGPRGYYYYGOMDV (SEQ ID NO:672).

Antibody 124-G12 has a LC variable domain that includes, at CDR1, the sequence SPSGGGLRNKYVS (SEQ ID NO:673), at CDR2, the sequence KDAERPS (SEQ ID NO:674), and, at CDR3, the sequence LAWDSTTRV (SEQ ID NO:675). It has a HC variable domain that includes, at CDR1, the sequence HYKMN (SEQ ID NO:676), at CDR2, the sequence YIGSSGGKTGYADSVKG (SEQ ID NO:677), and, at CDR3, the sequence VGVWYGMDV (SEQ ID NO:6).

Antibody 131-A03 has a LC variable domain that includes, at CDR1, the sequence RASQSISNWLA (SEQ ID NO:679), at CDR2, the sequence KASTLQT (SEQ ID NO:680), and, at CDR3, the sequence QQTYSAPFN (SEQ ID NO:681). It has a HC variable domain that includes, at CDR1, the sequence NYNMH (SEQ ID NO:682), at CDR2, the sequence VIYPSGGYTVYADSVKG (SEQ ID NO:683), and, at CDR3, the sequence RGNWGGIDY (SEQ ID NO:684).

Antibody 099-D05 has a LC variable domain that includes, at CDR1, the sequence RTSQTVSTFLN (SEQ ID NO:685), at CDR2, the sequence AASRLQS (SEQ ID NO:686), and, at CDR3, the sequence QQSFTSPRT (SEQ ID NO:687). It has a HC variable domain that includes, at CDR1, the sequence RYVMH (SEQ ID NO:688), at CDR2, the sequence YISPSGGVTKYADSVKG (SEQ ID NO:689), and, at CDR3, the sequence ALYPGMGYYYGMDV (SEQ ID NO:690).

Antibody 131-C08 has a LC variable domain that includes, at CDR1, the sequence RPSQSVYSNYLA (SEQ ID NO:691), at CDR2, the sequence GASTRAT (SEQ ID NO:692), and, at CDR3, the sequence QQYGNSYT (SEQ ID NO:693). It has a HC variable domain that includes, at CDR1, the sequence HYNMT (SEQ ID NO:694), at CDR2, the sequence SIWPSGGATRYADSVKG (SEQ ID NO:695), and, at CDR3, the sequence TSRFYGMDV (SEQ ID NO:696).

Antibody 116-C09 has a LC variable domain that includes, at CDR1, the sequence RASQSVNIDVG (SEQ ID NO:697), at CDR2, the sequence DASKRAT (SEQ ID NO:698), and, at CDR3, the sequence QQRARWLT (SEQ ID NO:699). It has a HC variable domain that includes, at CDR1, the sequence NYFMN (SEQ ID NO:700), at CDR2, the sequence SIGSSGGYTRYADSVKG (SEQ ID NO:701), and, at CDR3, the sequence VGVWYGMDV (SEQ ID NO:6).

Antibody 128-F11 has a LC variable domain that includes, at CDR1, the sequence RASQDIRTWLA (SEQ ID NO:703), at CDR2, the sequence SSSSLQS (SEQ ID NO:704), and, at CDR3, the sequence QQATTFPWT (SEQ ID NO:705). It has a HC variable domain that includes, at CDR1, the sequence HYIMH (SEQ ID NO:706), at CDR2, the sequence GIYPSGGSTKYADSVKG (SEQ ID NO:707), and, at CDR3, the sequence ALVGALDY (SEQ ID NO:708).

Antibody 131-D12 has a LC variable domain that includes, at CDR1, the sequence RASQGISNYLA (SEQ ID NO:709), at CDR2, the sequence AASTLQS (SEQ ID NO:7 10), and, at CDR3, the sequence EQLNSFPHA (SEQ ID NO:7 11). It has a HC variable domain that includes, at CDR1, the sequence RYTME (SEQ ID NO:712), at CDR2, the sequence VIRPSGGTTMYADSVKG (SEQ ID NO:713), and, at CDR3, the sequence VGVWYGMDV (SEQ ID NO:6).

Antibody 128-A06 has a LC variable domain that includes, at CDR1, the sequence RASQSVSRWLA (SEQ ID NO:715), at CDR2, the sequence KASTLES (SEQ ID NO:716), and, at CDR3, the sequence QQYGA (SEQ ID NO:717). It has a HC variable domain that includes, at CDR1, the sequence HYTMQ (SEQ ID NO:718), at CDR2, the sequence SIYPSGGATKYADSVKG (SEQ ID NO:719), and, at CDR3, the sequence SGYYYGLDV (SEQ ID NO:720).

Antibody 095-G09 has a LC variable domain that includes, at CDR1, the sequence RASQSVSSYLA (SEQ ID NO:91), at CDR2, the sequence DASNRAT (SEQ ID NO:92), and, at CDR3, the sequence QQRSN (SEQ ID NO:723). It has a HC variable domain that includes, at CDR1, the sequence HYTMW (SEQ ID NO:724), at CDR2, the sequence RIWPSGGTTRYADSVKG (SEQ ID NO:725), and, at CDR3, the sequence GGSYLAFDI (SEQ ID NO:726).

Antibody 137-G10 has a LC variable domain that includes, at CDR1, the sequence QGDSLRNYHPS (SEQ ID NO:727), at CDR2, the sequence FGRNNRPS (SEQ ID NO:728), and, at CDR3, the sequence SSRDGSGNFL (SEQ ID NO:729). It has a HC variable domain that includes, at CDR1, the sequence NYTMM (SEQ ID NO:730), at CDR2, the sequence GIYPSGGQTAYADSVKG (SEQ ID NO:731), and, at CDR3, the sequence GGSWYAFDI (SEQ ID NO:732).

Antibody 106-E12 has a LC variable domain that includes, at CDR1, the sequence RASQSISSFLN (SEQ ID NO:733), at CDR2, the sequence YAASSLQS (SEQ ID NO:734), and, at CDR3, the sequence QQSYSTPYT (SEQ ID NO:735). It has a HC variable domain that includes, at CDR1, the sequence WYSMT (SEQ ID NO:736), at CDR2, the sequence SISPSGGATKYADSVKG (SEQ ID NO:737), and, at CDR3, the sequence GGAASLPFDY (SEQ ID NO:738).

Antibody 124-H10 has a LC variable domain that includes, at CDR1, the sequence RASQSVGGYLA (SEQ ID NO:739), at CDR2, the sequence DASKRAT (SEQ ID NO:740), and, at CDR3, the sequence QQRSKWPPYT (SEQ ID NO:741). It has a HC variable domain that includes, at CDR1, the sequence HYKMM (SEQ ID NO:742), at CDR2, the sequence YIYPSGGWTGYADS-VKG (SEQ ID NO:743), and, at CDR3, the sequence VGPWDAFDI (SEQ ID NO:744).

Antibody 122-D01 has a LC variable domain that includes, at CDR1, the sequence RASESVSSSYFA (SEQ ID NO:745), at CDR2, the sequence GASRRVT (SEQ ID NO:746), and, at CDR3, the sequence QQYGGSPRS (SEQ ID NO:747). It has a HC variable domain that includes, at CDR1, the sequence RYMME (SEQ ID NO:748), at CDR2, the sequence GISPSGGTTKYADSVKG (SEQ ID NO:749), and, at CDR3, the sequence GGYNNYYYALDV (SEQ ID NO:750).

Antibody 093-C10 has a LC variable domain that includes, at CDR1, the sequence TGTGSNIDGYNYVS (SEQ ID NO:751), at CDR2, the sequence DVGKRPS (SEQ ID NO:752), and, at CDR3, the sequence CSYAGSYSYV (SEQ ID NO:753). It has a HC variable domain that includes, at CDR1, the sequence RYLMW (SEQ ID NO:754), at CDR2, the sequence VIGPSGGWTRYADS-VKG (SEQ ID NO:755), and, at CDR3, the sequence HPGDY (SEQ ID NO:756).

Antibody 106-C06 has a LC variable domain that includes, at CDR1, the sequence SGTSSDVGAYYHVS (SEQ ID NO:757), at CDR2, the sequence DVSNRPS (SEQ ID NO:2), and, at CDR3, the sequence SLYIGTSTPWV (SEQ ID NO:759). It has a HC variable domain that includes, at CDR1, the sequence HYRMD (SEQ ID NO:760), at CDR2, the sequence GIYPSGGHTNYADS-VKG (SEQ ID NO:761), and, at CDR3, the sequence DRGWYGADY (SEQ ID NO:762).

Antibody 117-B07 has a LC variable domain that includes, at CDR1, the sequence TGTTRDVGAYKYVS (SEQ ID NO:763), at CDR2, the sequence DVSKRPS (SEQ ID NO:764), and, at CDR3, the sequence CSFAGSYTWI (SEQ ID NO:765). It has a HC variable domain that includes, at CDR1, the sequence HYWMV (SEQ ID NO:766), at CDR2, the sequence WIGPSGGGTVYADS-VKG (SEQ ID NO:767), and, at CDR3, the sequence GNGGFDS (SEQ ID NO:216.

Antibody 126-H09 has a LC variable domain that includes, at CDR1, the sequence SGSRSNIGTNPVN (SEQ ID NO:769), at CDR2, the sequence VNNQRPS (SEQ ID NO:770), and, at CDR3, the sequence ATWDGSLNGPV (SEQ ID NO:771). It has a HC variable domain that includes, at CDR1, the sequence SYAMT (SEQ ID NO:772), at CDR2, the sequence SISSSGGDTAYADSVKG (SEQ ID NO:773), and, at CDR3, the sequence ERHYI-WGSYRYSWFDP (SEQ ID NO:774).

Antibody 093-G09 has a LC variable domain that includes, at CDR1, the sequence SGSSSNIGSNNVN (SEQ ID NO:775), at CDR2, the sequence SNDQRPS (SEQ ID NO:776), and, at CDR3, the sequence AAWDDSLNGPV (SEQ ID NO:777). It has a HC variable domain that includes, at CDR1, the sequence HYLMV (SEQ ID NO:778), at CDR2, the sequence GIVPSGGYTMYADS-VKG (SEQ ID NO:779), and, at CDR3, the sequence ASYSSFGLDY (SEQ ID NO:780).

Antibody 114-E02 has a LC variable domain that includes, at CDR1, the sequence RASQSISSWLA (SEQ ID NO:781), at CDR2, the sequence KASSLES (SEQ ID NO:782), and, at CDR3, the sequence QQYNSYPVT (SEQ ID NO:783). It has a HC variable domain that includes, at CDR1, the sequence FYPMS (SEQ ID NO:784), at CDR2, the sequence YIWPSGGATRYADSVKG (SEQ ID NO:785), and, at CDR3, the sequence GNGGFDS (SEQ ID NO:216).

Antibody 102-G11 has a LC variable domain that includes, at CDR1, the sequence TGTSSDIGAYPFVS (SEQ ID NO:787), at CDR2, the sequence GVTTRPF (SEQ ID NO:788), and, at CDR3, the sequence SSYAGGRNLPYV (SEQ ID NO:789). It has a HC variable domain that includes, at CDR1, the sequence HYYMA (SEQ ID NO:790), at CDR2, the sequence YISPSGGSTKYADS-VKG (SEQ ID NO:791), and, at CDR3, the sequence GGGTGTFDI (SEQ ID NO:792).

Antibody 132-C01 has a LC variable domain that includes, at CDR1, the sequence RASQSISRWLA (SEQ ID NO:793), at CDR2, the sequence EASTLES (SEQ ID NO:794), and, at CDR3, the sequence QQYNSYPLT (SEQ ID NO:795). It has a HC variable domain that includes, at CDR1, the sequence HYPMH (SEQ ID NO:796), at CDR2, the sequence SIWPSGGHTSYADSVKG (SEQ ID NO:797), and, at CDR3, the sequence LSQPI (SEQ ID NO:798).

Antibody 123-E02 has a LC variable domain that includes, at CDR1, the sequence RASQSVSNFLA (SEQ ID NO:799), at CDR2, the sequence GASNRAT (SEQ ID NO:800), and, at CDR3, the sequence QQANSFPLT (SEQ ID NO:801). It has a HC variable domain that includes, at CDR1, the sequence MYRMF (SEQ ID NO:802), at CDR2, the sequence VIGPSGGQTAYADSVKG (SEQ ID NO:803), and, at CDR3, the sequence VGVWYGMDV (SEQ ID NO:6).

Antibody 096-D03 has a LC variable domain that includes, at CDR1, the sequence TGTSGEVANYNYVS (SEQ ID NO:805), at CDR2, the sequence DVSRRPS (SEQ ID NO:806), and, at CDR3, the sequence ASYVGNDKLV (SEQ ID NO:807). It has a HC variable domain that includes, at CDR1, the sequence HYGMN (SEQ ID NO:808), at CDR2, the sequence SIWSSGGYTTYADS-VKG (SEQ ID NO:809), and, at CDR3, the sequence VGIWYSMDV (SEQ ID NO:810).

Antibody 131-G06 has a LC variable domain that includes, at CDR1, the sequence RASQSINSYLN (SEQ ID NO:811), at CDR2, the sequence AASSLQN (SEQ ID NO:812), and, at CDR3, the sequence QQSYSTPLT (SEQ ID NO:9). It has a HC variable domain that includes, at CDR1, the sequence RYTMF (SEQ ID NO:814), at CDR2, the sequence GIYPSGGKTIYADSVKG (SEQ ID NO:815), and, at CDR3, the sequence GGVFGVVDY (SEQ ID NO:816).

Antibody 094-D08 has a LC variable domain that includes, at CDR1, the sequence RASQGISNYLA (SEQ ID NO:817), at CDR2, the sequence AASTLQS (SEQ ID NO:818), and, at CDR3, the sequence QKYNSAPLT (SEQ ID NO:819). It has a HC variable domain that includes, at CDR1, the sequence HYPMD (SEQ ID NO:820), at CDR2, the sequence RIYPSGGATKYADSVKG (SEQ ID NO:821), and, at CDR3, the sequence GGGAFDI (SEQ ID NO:822).

Antibody 128-E07 has a LC variable domain that includes, at CDR1, the sequence RASQSVSSYLA (SEQ ID NO:91), at CDR2, the sequence DASNRAT (SEQ ID NO:92), and, at CDR3, the sequence QQRSNWLT (SEQ ID NO:825). It has a HC variable domain that includes, at CDR1, the sequence HYEMA (SEQ ID NO:826), at CDR2, the sequence SVIYPSGGATRYADSVKG (SEQ ID NO:827), and, at CDR3, the sequence VAQYYGMDV (SEQ ID NO:828).

Antibody 114-F04 has a LC variable domain that includes, at CDR1, the sequence RASQSVSSNYLA (SEQ ID NO:829), at CDR2, the sequence AASSLQS (SEQ ID NO:8), and, at CDR3, the sequence QQRWT (SEQ ID NO:831). It has a HC variable domain that includes, at CDR1, the sequence WYTMQ (SEQ ID NO:832), at CDR2, the sequence RIYSSGGGTYYADSVKG (SEQ ID NO:833), and, at CDR3, the sequence VGPWGAFDI (SEQ ID NO:834).

Antibody 122-A05 has a LC variable domain that includes, at CDR1, the sequence TGTSSDVGGYNYVS (SEQ ID NO:835), at CDR2, the sequence EVSNRPS (SEQ ID NO:68), and, at CDR3, the sequence SSYTSSSTWV (SEQ ID NO:837). It has a HC variable domain that includes, at CDR1, the sequence HYVMV (SEQ ID NO:838), at CDR2, the sequence SIYPSGGMTVYADS-VKG (SEQ ID NO:839), and, at CDR3, the sequence RGIANSFNI (SEQ ID NO:840).

Antibody 102-H02 has a LC variable domain that includes, at CDR1, the sequence RASQSISRYLN (SEQ ID NO:841), at CDR2, the sequence AASNLQS (SEQ ID NO:842), and, at CDR3, the sequence QQSYSTPWT (SEQ ID NO:843). It has a HC variable domain that includes, at CDR1, the sequence KYYMV (SEQ ID NO:844), at CDR2, the sequence VIGPSGGWTTYADSVKG (SEQ ID NO:845), and, at CDR3, the sequence VDYSNYFDY (SEQ ID NO:846).

Antibody 092-G06 has a LC variable domain that includes, at CDR1, the sequence RASQSISSYLN (SEQ ID NO:7), at CDR2, the sequence AASSLQS (SEQ ID NO:8), and, at CDR3, the sequence QQSYSTPWT (SEQ ID NO:849). It has a HC variable domain that includes, at CDR1, the sequence SYIMI (SEQ ID NO:850), at CDR2, the sequence YIRPSGGYTKYADSVKG (SEQ ID NO:851), and, at CDR3, the sequence VINAGPGRGYY-WRGYSYSDAFDI (SEQ ID NO:852).

Antibody 113-E03 has a LC variable domain that includes, at CDR1, the sequence RASQGIGTHLN (SEQ ID NO:853), at CDR2, the sequence AASGLQS (SEQ ID NO:854), and, at CDR3, the sequence QQSYSVPRT (SEQ ID NO:855). It has a HC variable domain that includes, at CDR1, the sequence NYPMV (SEQ ID NO:856), at CDR2, the sequence VIGPSGGKTKYADSVKG (SEQ ID NO:857), and, at CDR3, the sequence VGVWYGMDV (SEQ ID NO:6).

Antibody 118-E07 has a LC variable domain that includes, at CDR1, the sequence TGTSSDVGAYNYVS (SEQ ID NO:97), at CDR2, the sequence EVSNRPS (SEQ ID NO:68), and, at CDR3, the sequence NSYTTSATLV (SEQ ID NO:861). It has a HC variable domain that includes, at CDR1, the sequence HYLMM (SEQ ID NO:962), at CDR2, the sequence SIRSSGGITRYADSVKG (SEQ ID NO:863), and, at CDR3, the sequence VGYYYG-MDV (SEQ ID NO:864).

Antibody 093-E11 has a LC variable domain that includes, at CDR1, the sequence RASQSITGYLN (SEQ ID NO:865), at CDR2, the sequence AASSLQS (SEQ ID NO:8), and, at CDR3, the sequence QQSYSTPYT (SEQ ID NO:867). It has a HC variable domain that includes, at CDR1, the sequence NYPMY (SEQ ID NO:868), at CDR2, the sequence RIGPSGGHTDYADSVKG (SEQ ID NO:869), and, at CDR3, the sequence AGVWSGLDY (SEQ ID NO:870).

Antibody 124-C12 has a LC variable domain that includes, at CDR1, the sequence RASQGISNYLA (SEQ ID NO:871), at CDR2, the sequence AASTLQS (SEQ ID NO:872), and, at CDR3, the sequence QKYNSAPWT (SEQ ID NO:873). It has a HC variable domain that includes, at CDR1, the sequence HYLMG (SEQ ID NO:874), at CDR2, the sequence VIWPSGGITKYADSVKG (SEQ ID NO:875), and, at CDR3, the sequence GNGGFDS (SEQ ID NO:216.

Antibody 115-F08 has a LC variable domain that includes, at CDR1, the sequence TGTNTDVGGYNFVS (SEQ ID NO:877), at CDR2, the sequence DVTNRPS (SEQ ID NO:878), and, at CDR3, the sequence SSYTSSSTWV (SEQ ID NO:879). It has a HC variable domain that includes, at CDR1, the sequence HYSML (SEQ ID NO:880), at CDR2, the sequence SIRPSGGFIKYADSVKG (SEQ ID NO:881), and, at CDR3, the sequence RGVWDAFDI (SEQ ID NO:882).

Antibody 121-H07 has a LC variable domain that includes, at CDR1, the sequence RASQSISSYLN (SEQ ID NO:7), at CDR2, the sequence AASSLQS (SEQ ID NO:8), and, at CDR3, the sequence QQSYSTPRT (SEQ ID NO:885). It has a HC variable domain that includes, at CDR1, the sequence RYAMG (SEQ ID NO:886), at CDR2, the sequence YIGPSGGNTTYADSVKG (SEQ ID NO:887), and, at CDR3, the sequence DVGGSGSYYMLSYYYYGMDV (SEQ ID NO:888).

Antibody 136-B06 has a LC variable domain that includes, at CDR1, the sequence RASQSVSSSYLA (SEQ ID NO:889), at CDR2, the sequence AASTRAT (SEQ ID NO:890), and, at CDR3, the sequence QQSYSTPWT (SEQ ID NO:891). It has a HC variable domain that includes, at CDR1, the sequence RYPMG (SEQ ID NO:892), at CDR2, the sequence SIYPSGGSTYYADSVKG (SEQ ID NO:893), and, at CDR3, the sequence VGVWYGMDV (SEQ ID NO:6).

Antibody 097-F08 has a LC variable domain that includes, at CDR1, the sequence SGDDLGGRHVS (SEQ ID NO:895), at CDR2, the sequence QDDKRPS (SEQ ID NO:896), and, at CDR3, the sequence LAWHNYKYV (SEQ ID NO:897). It has a HC variable domain that includes, at CDR1, the sequence NYLMG (SEQ ID NO:898), at CDR2, the sequence SIGPSGGYTKYADSVKG (SEQ ID NO:899), and, at CDR3, the sequence GTGTTFF (SEQ ID NO:900).

Antibody 107-B05 has a LC variable domain that includes, at CDR1, the sequence RASQSISSYLN (SEQ ID NO:7), at CDR2, the sequence AASSLQS (SEQ ID NO:8), and, at CDR3, the sequence QQSYSTLVT (SEQ ID NO:903). It has a HC variable domain that includes, at CDR1, the sequence HYMMQ (SEQ ID NO:904), at CDR2, the sequence GIGPSGGWTKYADSVKG (SEQ ID NO:905), and, at CDR3, the sequence LNYGDYV (SEQ ID NO:906).

Antibody 124-A01 has a LC variable domain that includes, at CDR1, the sequence RASQGISSSLA (SEQ ID NO:907), at CDR2, the sequence AASTLQS (SEQ ID NO:908), and, at CDR3, the sequence QQSYSTPWT (SEQ ID NO:909). It has a HC variable domain that includes, at CDR1, the sequence HYLMH (SEQ ID NO:910), at CDR2, the sequence SIYPSGGKTQYADSVKG (SEQ ID NO:911), and, at CDR3, the sequence VFGYYDFWSGYPGAFDY (SEQ ID NO:912).

Antibody 102-C12 has a LC variable domain that includes, at CDR1, the sequence GGNNIGSKNVH (SEQ ID NO:913), at CDR2, the sequence RDSNRPS (SEQ ID NO:914), and, at CDR3, the sequence QVWDSSTV (SEQ ID NO:915). It has a HC variable domain that includes, at CDR1, the sequence HYVMV (SEQ ID NO:916), at CDR2, the sequence GIRSSGGVTAYADSVKG (SEQ ID NO:917), and, at CDR3, the sequence VGVWYGMDV (SEQ ID NO:6).

Antibody 103-E09 has a LC variable domain that includes, at CDR1, the sequence RASQTVSSTYLA (SEQ ID NO:919), at CDR2, the sequence GASSRAT (SEQ ID NO:128), and, at CDR3, the sequence QQYGSSPPRYT (SEQ ID NO:921). It has a HC variable domain that includes, at CDR1, the sequence RYRMV (SEQ ID NO:922), at CDR2, the sequence SIYPSGGYTKYADSVKG (SEQ ID NO:923), and, at CDR3, the sequence VITYNNFDS (SEQ ID NO:924).

Antibody 131-F12 has a LC variable domain that includes, at CDR1, the sequence RASLSVSGYLN (SEQ ID NO:925), at CDR2, the sequence ATSSLQS (SEQ ID NO:926), and, at CDR3, the sequence QQSYSSPYT (SEQ ID NO:927). It has a HC variable domain that includes, at CDR1, the sequence HYAMF (SEQ ID NO:928), at CDR2, the sequence SIWPSGGKTMYADSVKG (SEQ ID NO:929), and, at CDR3, the sequence GGSYLAFDI (SEQ ID NO:930).

Antibody 093-C08 has a LC variable domain that includes, at CDR1, the sequence LASQSISSYLN (SEQ ID NO:931), at CDR2, the sequence DASSLES (SEQ ID NO:932), and, at CDR3, the sequence QQFNGYPPIT (SEQ ID NO:933). It has a HC variable domain that includes, at CDR1, the sequence RYPMI (SEQ ID NO:934), at CDR2, the sequence VIYPSGGMTKYADSVKG (SEQ ID NO:935), and, at CDR3, the sequence VGSYGSLGY (SEQ ID NO:936).

Antibody 115-F04 has a LC variable domain that includes, at CDR1, the sequence GASQSVSTTYIA (SEQ ID NO:937), at CDR2, the sequence GASNRAT (SEQ ID NO:938), and, at CDR3, the sequence QQYGSSPYT (SEQ ID NO:939). It has a HC variable domain that includes, at CDR1, the sequence RYWMW (SEQ ID NO:940), at CDR2, the sequence SIGPSGGATRYADSVKG (SEQ ID NO:941), and, at CDR3, the sequence GSAGN (SEQ ID NO:942).

Antibody 113-G11 has a LC variable domain that includes, at CDR1, the sequence RASQSIDTYLN (SEQ ID NO:943), at CDR2, the sequence AASKLED (SEQ ID NO:944), and, at CDR3, the sequence QPYNTYPIT (SEQ ID NO:945). It has a HC variable domain that includes, at CDR1, the sequence HYGMY (SEQ ID NO:946), at CDR2, the sequence SIYPSGGWTNYADSVKG (SEQ ID NO:947), and, at CDR3, the sequence RGSWGAFDI (SEQ ID NO:948).

Antibody 102-C02 has a LC variable domain that includes, at CDR1, the sequence RASQSVSNSYLA (SEQ ID NO:949), at CDR2, the sequence GASSRAT (SEQ ID NO:128), and, at CDR3, the sequence QQFGSSTGYT (SEQ ID NO:951). It has a HC variable domain that includes, at CDR1, the sequence YYMMG (SEQ ID NO:952), at CDR2, the sequence SIYTSGGYTKYADSVKG (SEQ ID NO:953), and, at CDR3, the sequence ASIYYGMDV (SEQ ID NO:954).

Antibody 112-D04 has a LC variable domain that includes, at CDR1, the sequence RASQGISSWLA (SEQ ID NO:13), at CDR2, the sequence AASSLQS (SEQ ID NO:[[956]]8), and, at CDR3, the sequence QQANSFPYT (SEQ ID NO:957). It has a HC variable domain that includes, at CDR1, the sequence YYLMG (SEQ ID NO:958), at CDR2, the sequence SIGPSGGTTKYADSVKG (SEQ ID NO:959), and, at CDR3, the sequence RGLGAAFDY (SEQ ID NO:960).

Antibody 108-E10 has a LC variable domain that includes, at CDR1, the sequence RASQSVSSSYLA (SEQ ID NO:961), at CDR2, the sequence GASSRAT (SEQ ID NO:128), and, at CDR3, the sequence QQYGSSSFT (SEQ ID NO:963). It has a HC variable domain that includes, at CDR1, the sequence HYIMM (SEQ ID NO:964), at CDR2, the sequence SIYPSGGSTIYADSVKG (SEQ ID NO:965), and, at CDR3, the sequence ATEGYYYGMDV (SEQ ID NO:966).

Antibody 104-D12 has a LC variable domain that includes, at CDR1, the sequence RASQGIRSWLA (SEQ ID NO:967), at CDR2, the sequence AASSLQS (SEQ ID NO:8), and, at CDR3, the sequence QQSYSTPWT (SEQ ID NO:969). It has a HC variable domain that includes, at CDR1, the sequence WYRMA (SEQ ID NO:970), at CDR2, the sequence YIGPSGGSTSYADSVKG (SEQ ID NO:971), and, at CDR3, the sequence VGTFYGMDV (SEQ ID NO:972).

Antibody 116-E08 has a LC variable domain that includes, at CDR1, the sequence RASQTISSYLN (SEQ ID NO:973), at CDR2, the sequence AASSLQS (SEQ ID NO:8), and, at CDR3, the sequence QQSYSTPMYT (SEQ ID NO:975). It has a HC variable domain that includes, at CDR1, the sequence WYLMG (SEQ ID NO:976), at CDR2, the sequence VIGPSGGLTKYADSVKG (SEQ ID NO:977), and, at CDR3, the sequence FRGYYGMDV (SEQ ID NO:978).

Antibody 102-D07 has a LC variable domain that includes, at CDR1, the sequence RASQSVRKNVA (SEQ ID NO:979), at CDR2, the sequence GASTRAT (SEQ ID NO:980), and, at CDR3, the sequence QQYSSWPA (SEQ ID NO:981). It has a HC variable domain that includes, at CDR1, the sequence NYLMY (SEQ ID NO:982), at CDR2, the sequence SIRPSGGNTLYADSVKG (SEQ ID NO:983), and, at CDR3, the sequence GRGILTGYYWGYYYYMDV (SEQ ID NO:984).

Antibody 103-H07 has a LC variable domain that includes, at CDR1, the sequence RASQSISSSYLA (SEQ ID NO:985), at CDR2, the sequence HASSRAT (SEQ ID NO:986), and, at CDR3, the sequence QQRNNWPPSFT (SEQ ID NO:987). It has a HC variable domain that includes, at CDR1, the sequence LYLME (SEQ ID NO:988), at CDR2, the sequence SIGSSGGATWYADSVKG (SEQ ID NO:989), and, at CDR3, the sequence DTSRVAGTRLRNYYYYYGMDV (SEQ ID NO:990).

Antibody 116-A08 has a LC variable domain that includes, at CDR1, the sequence RASQSIGTLLN (SEQ ID NO:991), at CDR2, the sequence GASNLRG (SEQ ID NO:992), and, at CDR3, the sequence QHDT (SEQ ID NO:993). It has a HC variable domain that includes, at CDR1, the sequence WYRMH (SEQ ID NO:994), at CDR2, the sequence SIWPSGGKTHYADSVKG (SEQ ID NO:995), and, at CDR3, the sequence ALQYGSGSYFYAPKSYYYYGMDV (SEQ ID NO:996).

Antibody 106-D06 has a LC variable domain that includes, at CDR1, the sequence RASQTISRYLN (SEQ ID NO:997), at CDR2, the sequence AASSLQS (SEQ ID NO:8), and, at CDR3, the sequence QQSYSAPRT (SEQ ID NO:999). It has a HC variable domain that includes, at CDR1, the sequence KYKMG (SEQ ID NO:1000), at CDR2, the sequence YIRPSGGMTFYADSVKG (SEQ ID NO:1001), and, at CDR3, the sequence EHYQASYSSSAWFRMVPAGAFDI (SEQ ID NO:1002).

Antibody 113-D05 has a LC variable domain that includes, at CDR1, the sequence RASQGIRRALA (SEQ ID NO:1003), at CDR2, the sequence DASSLES (SEQ ID NO:1004), and, at CDR3, the sequence QQSYSTPPWT (SEQ ID NO:1005). It has a HC variable domain that includes, at CDR1, the sequence YYKMH (SEQ ID NO:1006), at CDR2, the sequence VIYPSGGKTFYADSVKG (SEQ ID NO:1007), and, at CDR3, the sequence EHYQASYSSSAWFRMVPAGAFDI (SEQ ID NO:1002).

Antibody 110-D06 has a LC variable domain that includes, at CDR1, the sequence RASQSVVSNFLA (SEQ ID NO:1009), at CDR2, the sequence GASSRAT (SEQ ID NO:128), and, at CDR3, the sequence QQYGSSPYS (SEQ ID NO:1011). It has a HC variable domain that includes, at CDR1, the sequence NYVMY (SEQ ID NO:1012), at CDR2, the sequence GIGPSGGFTTYADSVKG (SEQ ID NO:1013), and, at CDR3, the sequence DRYFGSGYYMAAYYYYGMDV (SEQ ID NO:1014).

Antibody 124-C04 has a LC variable domain that includes, at CDR1, the sequence RASQRVSSTFLA (SEQ ID NO:1015), at CDR2, the sequence GTSSRAT (SEQ ID NO:1016), and, at CDR3, the sequence HQYGSSPRT (SEQ ID NO:1017). It has aHC variable domain that includes, at CDR1, the sequence WYAMM (SEQ ID NO:1018), at CDR2, the sequence SIWPSGGHTKYADSVKG (SEQ ID NO:1019), and, at CDR3, the sequence DQGYF (SEQ ID NO:1020).

Antibody 097-B12 has a LC variable domain that includes, at CDR1, the sequence RASQPISTSLA (SEQ ID NO:318), at CDR2, the sequence KASILET (SEQ ID NO:301), and, at CDR3, the sequence QQYASPSYT (SEQ ID NO:302). It has a HC variable domain that includes, at CDR1, the sequence KYVMW (SEQ ID NO:307), at CDR2, the sequence SIVSSGGRTSYADSVKG (SEQ ID NO:308), and, at CDR3, the sequence AYDYVWGSYRYKGRPVGAFDI (SEQ ID NO:312). This antibody was found to inhibit both mK1 and hK1.

Some of the exemplary antibodies described herein have sequence inter-relationships. Two antibodies that share LC, HC CDR3, or HC CDR1 and HC CDR2 are likely to bind to approximately the same site on hK1. A common HC CDR3 is especially indicative of a shared binding site. Thus, the inhibitory properties of two antibodies that share the named areas of sequence are likely to be similar. In particular, if one antibody is an inhibitor of hK1, then any antibody that shares the sequence of the first antibody is likely to also be an inhibitor. For example:

M0098-G05 and M0097-G07 have identical HC variable domains, but their LC variable domains differ.

M0103-A01 and M0096-D09 have identical HC variable domains, but their LC variable domains differ.

M0114-D02 and M0097-G01 have identical HC variable domains, but their LC variable domains differ.

M0117-F08 and M0102-G12 have identical HC variable domains, but their LC variable domains differ. M0102-G12 is known to inhibit hK1.

M0131-C08 and M0093-G09 have identical HC variable domains, but their LC variable domains differ.

M0131-C09 and M0096-D09 have identical HC variable domains, but their LC variable domains differ.

M0131-F07 and M0102-G12 have identical HC variable domains, but their LC variable domains differ. M0131-F07 and M0102-G12 are known to inhibit hK1.

M0131-G03 and M0098-H04 have identical LC variable domains.

M0133-E08 and M0102-G12 have identical LC variable domains. M0102-G12 is known to inhibit hK1.

M0136-A07 and M0096-D09 have identical HC variable domains, but their LC variable domains differ.

M0138-B04 and M0102-G12 have identical HC variable domains, but their LC variable domains differ. M0102-G12 is known to inhibit hK1.

M0138-G11 and M0133-E02 have identical LC variable domains.

The following HC variable domains have the same CDR3 sequence (VGVWYGMDV SEQ ID NO:6): M0092-F08; M0093-C08; M0093-C10; 14(M0095-A11; M0097-E07; M0097-F08; M0102-H02; M0103-F07; M0104-H12; M0107-F11; M0109-E08; M0110-D11; M0111-C10; M0112-C12; M0112-D04; M0114-G09; M0117-A12;

M0124-H10; M0128-A06; M0130-B02; M0131-B05; M0131-F09;M0135-B05; M0135-F03; M0136-E12; M0138-E02; M0139-F09).

The HC variable domains of M0096-D03, M0102-C12, M0126-F11, and M0128-E07) share cdr3=GNGGFDS (SEQ ID NO:216). The HC variable domains of M0097-D04 and M0134-D07) share cdr3=RGPVYYYDSSGSHSAFDI (SEQ IDNO:120).

The HC variable domains of M0097-G07 and M0139-C02 share cdr3=EHYQASYSSSAWFRMVPAGAFDI (SEQ ID NO:1002). The HC variable domains of M0101-E01 and 1M0136-D07 share cdr3=NINLRYDILTGYFDI (SEQ ID NO:84). The HC variable domains of M0102-G12 and M0110-G01 share cdr3=DITPGGGSGFRLPKNYYYYGMDV (SEQ ID NO:12). M0102-12 inhibits hK1. The HC variable domains of M0102-G12 and M0133-E08 share cdr3=DITPGGGSGFRLPKNYYYYGMDV (SEQ ID NO:12). M0102-G12 inhibits hK1. Their LC variable domains are the same. The HC variable domains of M0102-G12 and M0139-F04 share cdr3=DITPGGGSGFRLPKNYYYYGMDV (SEQ ID NO:12); M0139-F04 and M0102-G12 inhibit hK1. Their LC variable domains differ. The HC variable domains of M0104-D12 and M0117-B07 share cdr3=GGSYLAFDI LCs differ. M0105-B06 and M0116-C09 share cdr3=GYSSTWGAFDI (SEQ ID NO:396). M0105-B06 and M0138-E12 share cdr3=GYSSTWGAFDI (SEQ ID NO:396). M0133-E02 and M0138-G11) share cdr3=DTRVGPWLVRAPLDY (SEQ ID NO:276).

M0102-G12 and M0133-E08 share HC CDR1=KyKmV (SEQ ID NO:10) and HC CDR2=SiYPsggItAyadsvkg (SEQ ID NO:11). M0102-G12 inhibits hK1. M0107-D12 and M0110-G01 share HC CDR1=MyKmG (SEQ ID NO:220) and HC CDR2=SiVPsggKtQyadsvkg (SEQ ID NO:221). M0133-E02 and M0138-G11 share HC CDR1=WyTmT and HC CDR2=SiYPsggHtSyadsvkg (SEQ ID NO:275).

Sequences of exemplary antibodies that have at least one CDR in common with an identified hK1 inhibitor are likely to also be inhibitors.

M0103-A03 does not have C at 96.

M0107-D12 contains stops.

M0107-D12 does not have WG motif at start of FR4

The sequence of an exemplary HC variable domain and sequences, C-terminal to the variable domain, e.g., extending towards the end of CH1 is as follows.

```
>HC-092-B12-CH1 (SEQ ID NO:182)
EVQLLESGGG LVQPGGSLRL SCAASGFTFS QYLMAWVRQA
PGKGLEWVSS IYPSGGNTNY ADSVKGRFTI SRDNSKNTLY
LQMNSLRAED TAVYYCARDR SIVPYSSSWY MPRDYYYGMD
VWGQGTTVTV SSASTKGPSV FPLAPSSKST SGGTAALGCL
VKDYFPEPVT VSWNSGALTS GVHTFPAVLQ SSGLYSLSSV
VTVPSSSLGT QTYICNVNHK PSNTKVDKKV EPKSC
```

The combination of a VL-Clight with VH-CH1 expressed in eukaryotic, yeast, or bacterial cells with proper folding gives rise to an Fab. Fabs are monomeric and typically have molecular mass of about 50 kDa.

The following sequence exemplifies a HC variable domain extended through CH1, hinge, CH2 and CH3 of a human IgG1:

```
>HC-093-C10-CH1-H-CH2-CH3 (SEQ ID NO:179)
EVQLLESGGG LVQPGGSLRL SCAASGFTFS RYTMEWVRQA
```

```
                          -continued
PGKGLEWVSV IRPSGGTTMY ADSVKGRFTI SRDNSKNTLY
LQMNSLRAED MAVYYCARVG VWYGMDVWGQ GTTVTVSSAS
TKGPSVFPLA PSSKSTSGGT AALGCLVKDY FPEPVTVSWN
SGALTSGVHT FPAVLQSSGL YSLSSVVTVP SSSLGTQTYI
CNVNHKPSNT KVDKKVEPKS CDKTHTCPPC PAPELLGGPS
VFLFPPKPKD TLMISRTPEV TCVVVDVSHE DPEVKFNWYV
DGVEVHNAKT KPREEQYNST YRVVSVLTVL HQDWLNGKEY
KCKVSNKALP APIEKTISKA KGQPREPQVY TLPPSRDELT
KNQVSLTCLV KGFYPSDIAV EWESNGQPEN NYKTTPPVLD
SDGSFFLYSK LTVDKSRWQQ GNVFSCSVMH EALHNHYTQK
SLSLSPGK
```

Expression of a HC comprising VH::CH1::Hinge::CH2::CH3 together with LC comprising Vlight::Clight gives rise to an IgG. In the example given, one would obtain an IgG1. Other IgG types may be obtained by replacement of the DNA encoding CH1::Hinge::CH2::CH3 with DNA that encodes, for example, IgG4 or using modified Fc sequences.

The sequence of an exemplary LC variable domain and sequences, C-terminal to the variable domain, e.g., extending towards the end of Ckappa is as follows:

```
>LC-092-B12-Ckappa (SEQ ID NO:176)
AQDIQMTQSP SSLSASVGDR VTITCRASQG ISNYLAWYQQ
KPGKVPKLLI YAASTLQSGV PSRFSGSGSG TDFTLTISSL
QPEDFATYYC QQSYSTPYTF GQGTKLEVRR TVAAPSVFIF
PPSDEQLKSG TASVVCLLNN FYPREAKVQW KVDNALQSGN
SQESVTEQDS KDSTYSLSST LTLSKADYEK HKVYACEVTH
QGLSSPVTKS FNRGEC
```

The following LC sequence has a lambda 1 constant region:

```
>LC-103-F07-Clambda1 (SEQ ID NO:175)
AQSALTQPAS VSGSPGQSIT ISCTGTSNDI GRTNYVSWYR
QDPGRAPKLI LFEVSNRPSG ISNRFSASKS GSTASLTISG
LQADDESDYY CSSCTTAPVC VFGNGTRVTV LGQPKANPTV
TLFPPSSEEL QANKATLVCL ISDFYPGAVT VAWKADGSPV
KAGVETTKPS KQSNNKYAAS SYLSLTPEQW KSHRSYSCQV
THEGSTVEKT VAPTECS
```

The following LC sequence has a lambda 2 constant region:

```
>LC-131-D12-Clambda2 (SEQ ID NO:162)
AQSALTQPPS VSVAPGQTAS ISCSGNILDN SYASWFQQKP
GQSPVMVIHR DNKRPSGIPE RFSGSTSGNT ATLTISGTQA
VDEADYYCQA WDRTTGVFGT GTRLTVLRQP KAAPSVTLFP
PSSEELQANK ATLVCLISDF YPGAVTVAWK ADSSPVKAGV
ETTTPSKQSN NKYAASSYLS LTPEQWKSHR SYSCQVMHEG
STVEKTVAPA ECS
```

The following LC sequence has a lambda 7 constant region:

```
>LC-132-H11-Clambda7 (SEQ ID NO:158)
AQYELTQPPS ASGTPGQRVT ISCSGSSSNI GSNYVYWYQQ
LPGTAPKLLI YRNNQRPSGV PDRFSGSKSG TSASLAISGL
RSEDEADYYC AAWDDSLSGH AVFGGGTQLT VLGQPKAAPS
VTLFPPSSEE LQANKATLVC LVSDFYPGAV TVAWKADGSP
VKVGVETTKP SKQSNNKYAA SSYLSLTPEQ WKSHRSYSCR
VTHEGSTVEK TVAPTECS
```

Lambda light chains come in several types: e.g. lambda1, lambda2, and lambda7, depending on the sequence of Clambda. Antibodies having lambda LCs can be typed as follows.

Lambda7

LC-132-H11
Lambda2

LC-131-D12
LC-131-G06
LC-132-D02
LC-134-B03
LC-136-A07
LC-104-H12
LC-109-A11
LC-122-G06
LC-125-C04
LC-102-G12
LC-092-G06
LC-110-D11
LC-108-C10
LC-128-A06
LC-135-H01
LC-123-E02
Lambda1

LC-116-C09
LC-108-E11
LC-099-C12
LC-131-A03
LC-108-D11
LC-114-F04
LC-132-C01
LC-122-H04
LC-094-E08
LC-093-F09
LC-093-G06
LC-103-E09
LC-103-F07
LC-098-H04
LC-131-G03
LC-097-F04
LC-135-C12
LC-131-B05
LC-112-D04
LC-096-D03
LC-126-H09
LC-114-G09
LC-094-D08
LC-102-A04

Changing the Clambda from, for example, Clambda1 to Clambda2 is not expected to alter the binding properties of the expressed antibody in any important way. Thus, we could change the lambda constant region to alter the expression or pharmacokinetics without changing the binding properties (such as inhibition of hK1).

Protease Specificity of Selected Inhibitors

Selected antibodies were tested for their ability to inhibit other proteases. Shown in Table 2 are the results of testing 3 antibodies against 13 serine proteases besides hK1. It is evident that at the maximum tested concentration of antibody (1 μM) we observed no inhibition of any other proteases.

Procedure. Assays were performed in black, 96 well, round bottomed microplates in a total volume of 100 μL. The enzyme, substrate, buffer and experimental conditions are listed in Tables 3 and 4. Enzyme and Fab inhibitor were incubated in the dark at room temperature for 1 hour prior to the addition of the indicated amount of substrate. The rate of enzymatic substrate hydrolysis was then monitored using the Spectramax Gemini XS fluorescence plate reader using the wavelengths listed in Table 3.

TABLE 2

Specificity of hK1 Antibody Inhibitors.

| Protease | $K_i$ (nM) | | |
|---|---|---|---|
| | DX-2300 | M0093-F09 | M0137-E01 |
| hK1 | 0.039–0.06 | 1.9 | 0.9 |
| hK2 | >1000 | >1000 | >1000 |
| hK3 | >1000 | >1000 | >1000 |
| hK4 | >1000 | >1000 | >1000 |
| hK5 | >1000 | >1000 | >1000 |
| hK8 | >1000 | >1000 | >1000 |
| Human plasma kallikrein | >1000 | >1000 | >1000 |
| Human plasmin | >1000 | >1000 | >1000 |
| Human urokinase | >1000 | >1000 | >1000 |
| Human trypsin | >1000 | >1000 | >1000 |
| Human elastase | >1000 | >1000 | >1000 |
| Human activated protein kinase C | >1000 | >1000 | >1000 |
| Human chymotrypsin | >1000 | >1000 | >1000 |
| Human thrombin | >1000 | >1000 | >1000 |

TABLE 3

Summary of Assay Conditions Used in Protease Specificity Measurements

| Enzyme | Substrate | [S] (μM) | [E] (nM) | Buffer | λ Ex | λ Em |
|---|---|---|---|---|---|---|
| Recombinant (Pichia) Kallikrein | Pro-Phe-Arg-AMC | 100 | 5 | KAL | 360 | 460 |
| Human Urinary Kallikrein 1(hK1) | Pro-Phe-Arg-AMC | 100 | 5 | KAL | 360 | 460 |
| Human Tissue Kallikrein 2 (hK2) | Pro-Phe-Arg-AMC | 100 | 5 | KAL | 360 | 460 |
| Plasma Kallikrein | Pro-Phe-Arg-AMC | 100 | 5 | KAL | 360 | 460 |
| Human Tissue Kallikrein 3 (hK3, PSA) | Mu-His-Ser-Ser-Lys-Leu-Gln-AFC | 100 | 20 | PSA | 400 | 505 |
| Human Tissue Kallikrein 4 (hK4) | Boc-Val-Pro-Arg-AMC | 100 | 10 | KAL | 380 | 460 |
| Human Tissue Kallikrein 5 (hK5) | Boc-Val-Pro-Arg-AMC | 100 | 20 | KAL | 380 | 460 |

TABLE 3-continued

Summary of Assay Conditions Used in Protease Specificity Measurements

| Enzyme | Substrate | [S] (µM) | [E] (nM) | Buffer | λ Ex | λ Em |
|---|---|---|---|---|---|---|
| Human Tissue Kallikrein 8 (hK8) | Boc-Val-Pro-Arg-AMC | 100 | 40 | KAL | 380 | 460 |
| Plasmin | N-Suc-Ala-Phe-Lys-AMC | 100 | 5 | PLA | 360 | 460 |
| Human Pancreatic Trypsin | Pro-Phe-Arg-AMC | 100 | 5 | KAL | 360 | 460 |
| Human Neutrophil Elastase | N-MS-Ala-Ala-Pro-Val-AMC | 100 | 5 | KAL | 360 | 460 |
| Chymotrypsin | Trp-AMC | 100 | 5 | PSA | 360 | 460 |
| Protein Kinase C | Boc-Leu-Ser-Thr-Arg-AMC | 100 | 5 | PKC | 360 | 460 |
| Urokinase | Z-Gly-Gly-Arg-AMC | 100 | 5 | PSA | 360 | 460 |
| Thrombin | Benzoyl-Phe-Val-Arg-AMC | 500 | 5 | KAL | 350 | 470 |

TABLE 4

Buffer Components for Table 3

| KAL | PSA | PLA | PKC |
|---|---|---|---|
| 20 mM Tris pH 7.5 | 50 mM HEPES pH 7.5 | 50 mM HEPES pH 7.5 | 20 mM Tris-Cl pH 8.0 |
| 150 mM NaCl | 100 mM NaCl, | 150 mM NaCl | 100 mM NaCl |
| 1 mM EDTA | 0.2% BSA | 2 mM CaCl$_2$ | 1 mM CaCl$_2$ |
| 0.1% PEG | | 0.1% Triton X-100 | 0.1% Triton X-100 |
| 0.1% Triton X-100 | | | |

Effect of Selected Antibody Inhibitors on hK1 Kininogenase Activity

Select antibody inhibitors were examined to determine the effect on hK1 kininogenase activity. SDS-PAGE showed that all nine antibodies examined inhibitied kininogenase activity of hK1 towards high molecular weight kininogen (HMWK). Intact HMWK migrates as a 100 kDa protein that is digested by hK1 to give a fragment that runs at approximately 60 kDa (lanes 1 and 2). All 9 of the hK1 inhibitors (lanes 4 through 12) that were tested prevented HMWK digestion. Experiments were performed by incubating 10 nM hK1 with 1 µM Ab for 3 hours at 37° C. prior to the addition of 0.1 mg/mL HMWK. HMWK was reacted with hK1 for 3 hours at 37° C. Non-reducing SDS-PAGE gels (10% acrylamide) were loaded with 1 µg HMWK and run according to standard procedures. Lane 1 contains undigested HMWK, lane 2 contains digested HMWK, lane 3 contains molecular weight markers from Invitrogen, lane 4 contains HMWK+hK1+DX-2300, lane 5 contains HMWK+hK1+M0106-G12, lane 6 contains HMWK+hK1+M0111-C12, lane 7 contains HMWK+hK1+M0098-G05, lane 8 contains HMWK+hK1+M0137-E01, lane 9 contains HMWK+hK1+M0112-D03, lane 10 contains HMWK+hK1+M0102-H11, lane 11 contains HMWK+hK1+MO14-G06, lane 12 contains HMWK+hK1+M0098-E09.

Towards LMWK it is evident that all 9 Fabs inhibited the extent of digestion. However, only DX-2300 (lane 4) and M0137-E01 (lane 8) appeared to completely inhibit LMWK digestion. The reactions were performed as described above for HMWK and the lanes contain the same contents as above except that LMWK is substituted for HMWK.

Epitope Grouping of Selected hK1 Binding Antibodies

Selected antibodies were grouped according to whether or not that recognize the same epitope on hK1 as DX-2300 using a surface plasmon resonance (SPR) approach (FIG. 1, Table 5). This type of information can lead to the discovery of matched pairs of antibodies for quantitative measurements hK1 in biological samples. This information is also valuable to compare antibodies to the lead inhibitor (DX-2300) and choose back up inhibitors that either share the same epitope or different epitopes as DX-2300. FIG. 1 shows two representative sensorgrams for a Fab (M0112-D07) that shares the same epitope as DX-2300 (panel A) and a Fab that binds a different epitope (panel B). The ratio of the SPR signal for the Fab following the injection of DX-2300 (R1) divided by the signal of the Fab alone (R2) provides an indication of which Fabs share the same epitope as DX-2300. Since the second inject of DX-2300 produces a R2/R1 ratio of 0.1, Fabs with R2/R1 ratios significantly greater than 0.1 indicate binding at a different epitope than DX-2300. Out of the 12 Fabs that were examined, only M0111-C12, M0137-E01 and M0139-A09 did not share the same epitope as DX-2300 (Table 5). The epitope of certain Fabs (M0109-F02 and M0098-E09) may partially overlap that of DX-2300, since an intermediate signal response was observed (Table 5).

TABLE 5

Epitope Grouping By Surface Plasmon Resonance

| Fab | Fab Signal following DX-2300 (R1) | Fab Signal Alone (R2) | Ratio R1/R2 | Share DX-2300 epitope? |
|---|---|---|---|---|
| M0093-F09 | 5.9 | 32.7 | 0.18 | yes |
| M0111-C12 | 38.8 | 65.1 | 0.60 | no |
| M0137-E01 | 20.8 | 49.1 | 0.42 | no |
| M0109-F02 | 9.5 | 30.2 | 0.31 | partial |
| M0114-G06 | 4.8 | 27.5 | 0.17 | yes |
| M0098-E09 | 8.5 | 34.8 | 0.24 | yes |
| M0139-A09 | 25.7 | 40.0 | 0.64 | no |
| M0134-D07 | 2.3 | 14.7 | 0.16 | yes |
| M0117-F04 | 6.7 | 29.7 | 0.23 | yes |
| M0098-E09 | 8.5 | 29.9 | 0.28 | partial |
| M0136-A07 | 5.0 | 27.6 | 0.18 | yes |
| M0112-D07 | 3.0 | 16.1 | 0.19 | yes |
| M0131-F07 (DX-2300) | 3.8 | 27.6 | 0.1 | yes |

Mechanisms of hK1 Inhibition and $K_i$ Determinations for Selected Inhibitors

Because the best antibodies discovered are tight binding inhibitors of hK1, the classical Michaelis-Menten approach to determine enzyme inhibition mechanisms does not apply. A method to determine the inhibition mechanism of a tight binding inhibitor has been described (R. A. Copeland, "Enzymes", $2^{nd}$ Edition, Wiley, Toronto, 2000). Tight binding inhibitors refer to those inhibitors with inhibition constants ($K_i$ values) that approach the minimum enzyme concentration that can be used to measure activity, which for hK1 is approximately 1 nM. The tight binding inhibition method requires one to measure the $IC_{50}$ of the inhibitor at a range of different substrate concentrations. Under these conditions, an inhibitor that binds the enzyme in a manner that is competitive with respect to substrate will exhibit a linear increase in $IC_{50}$ in response to substrate concentration. In contrast, $IC_{50}$ values that do not vary with substrate concentration are indicate that the inhibitor binds the enzyme in a manner that is noncompetitive with respect to substrate. The binding of a noncompetitive inhibitor to an enzyme does not block the ability of substrate to bind enzyme but rather prevents the subsequent substrate hydrolysis step, presumably through a distortion of the catalytically important amino acids.

Figure 2:
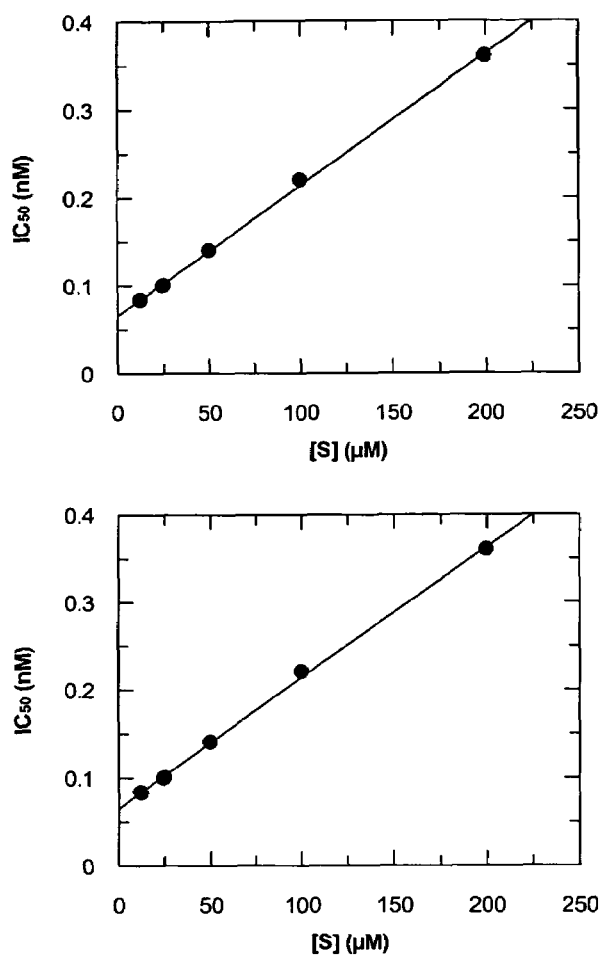
FIG. 2. Inhibition mechanism of DX-2300 (also referred to herein as "M0131-F07"). The inhibition mechanism of DX-2300 as a Fab (panel A) is shown to be competitive and to have a $K_i$ of 60±2 pM. The inhibition mechanism of DX-2300 as an IgG (panel B) is shown to be competitive and to have a $K_i$ of 39±4 pM.

DX-2300 exhibits a linear dependence of the $IC_{50}$ value on substrate concentration (FIG. 2). Consequently, DX-2300 is a tight binding inhibitor that inhibits hK1 in a competitive manner, which indicates that its binding to hK1 prevent substrate binding. Knowledge of the inhibition mechanism also permits the determination of the inhibition constant ($K_i$). DX-2300 has a $K_i$ value of 60 pM as a Fab and approximately 39 pM as an IgG.

Figure 3:
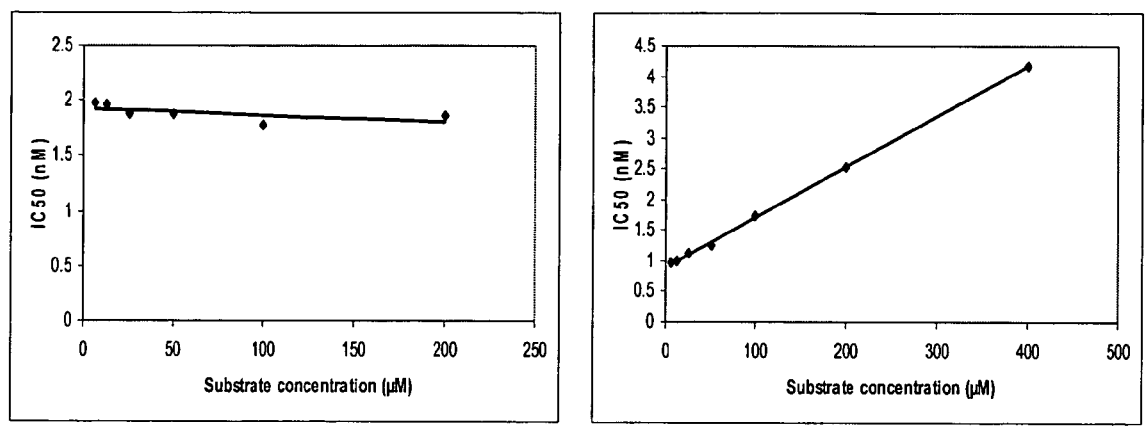
FIG. 3. Inhibition mechanisms of other hK1 inhibitors. The inhibition mechanism of M0093-F09 as a Fab (panel A) is shown to be noncompetitive and to have a $K_i$ of 1.9 nM. The inhibition mechanism of M0137-E01 as a Fab (panel B) is shown to be competitive and to have a $K_i$ of 0.9 nM.

Inhibition mechanisms and $K_i$ values were also determined for the selected backup antibodies, M0093-F09 and M0137-E01. As shown in FIG. 3A, M0093-F09 inhibits hK1 in a noncompetitive manner with a $K_i$ of 1.9 nM. FIG. 3B demonstrates that the backup antibody inhibitor M0137-E01 inhibits hK1 in a competitive manner with a $K_i$ of 0.9 nM.

Progress Curve Inhibition Analysis of DX-2300

Figure 4:
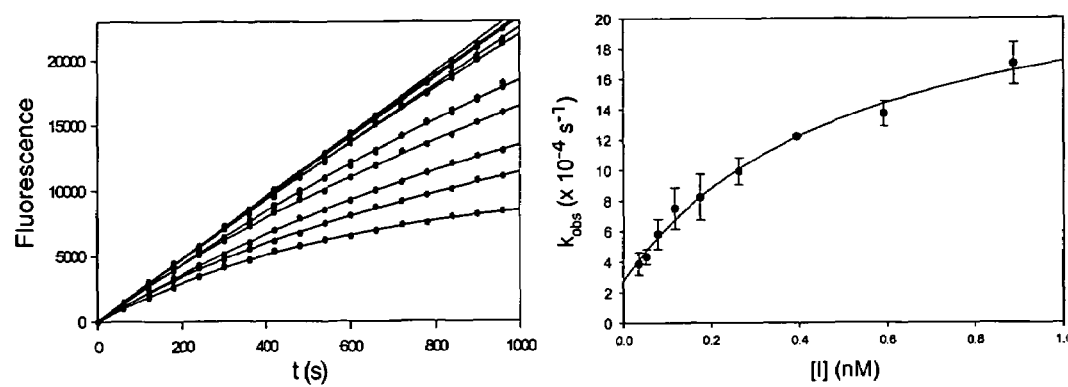
FIG. 4. Progress Curve Analysis of DX-2300. Kinetic progress curves (panel A) in the presence of increasing amounts of DX-2300 inhibitor were fit to the following equation to obtain kobs values, $F=v_s+(v_0-v_s)(1-\exp(-k_{obs}*t))/k_{obs}+C$, where F=fluorescence, $v_s$=final steady state rate, $v_0$=initial steady state rate, $k_{obs}$=exponential inhibition constant, t=time in seconds, and C is a constant to account for the initial background fluorescence at t=0 seconds. In panel B the $k_{obs}$ values were plotted against inhibitor concentrations and fit to an equation for a slow, tight binder with an isomerization step: $k_{obs}=k_6+(k_5*[I]/(K_{i,app}+[I]))$, where $k_6$ is the reverse reaction rate constant for the enzyme-inhibitor isomerization step, $k_5$ is the forward reaction rate constant for that step, $K_{i,app}$ is the apparent equilibrium inhibition constant for the formation of the initial enzyme-inhibitor complex, and [I] is the concentration of inhibitor present in the assay.

The time dependence of DX-2300 inhibition of hK1 was investigated using the progress curve method (R. A. Copeland, "Enzymes", $2^{nd}$ Edition, Wiley, Toronto, 2000). This method is used to characterize the kinetic step or steps that describe the interaction between inhibitor and enzyme. The progress curves shown in FIG. 4A demonstrate time dependent inhibition of hK1 by DX-2300 and the data obtained for each concentration of inhibitor were fit to provide exponential rate constants that describe the kinetics of the interaction between the enzyme and inhibitor. These rate constants ($k_{obs}$ values) when plotted against inhibitor concentration exhibit a hyperbolic dependence (FIG. 4B), which indicates that the initial complex between DX-2300 and hK1 undergoes an isomerization to form a new complex of even higher affinity.

DX-2300 Inhibition of Kallikrein-Like Activity in Animal Urine

Tissue kallikrein (K1) has been previously shown to be excreted in urine. Kizuki, K., et al., *Adv Exp Med Biol*, 1986. 198 Pt A:329-337; Takaoka, M., et al., *Biochem Biophys Res Commun*, 1984. 122(3): 1282-1288; Murthy, K. K., et al., *Arch Biochem Biophys*, 1986. 244(2):563-571; Stella, R. C., et al., Adv Exp Med Biol, 1989. 247B:195-200. Using synthetic peptide substrates the activity of K1 can be measured in urine. Often much of the excreted K1 is in the inactive proform so it is necessary to activate the enzyme with another protease such as trypsin or thermolysin. Prior to measuring the activity of K1 in the urine the activating enzyme is quenched using a specific inhibitor (soybean trypsin inhibitor for trypsin or phosphoramidon for thermolysin).

Figure 5:
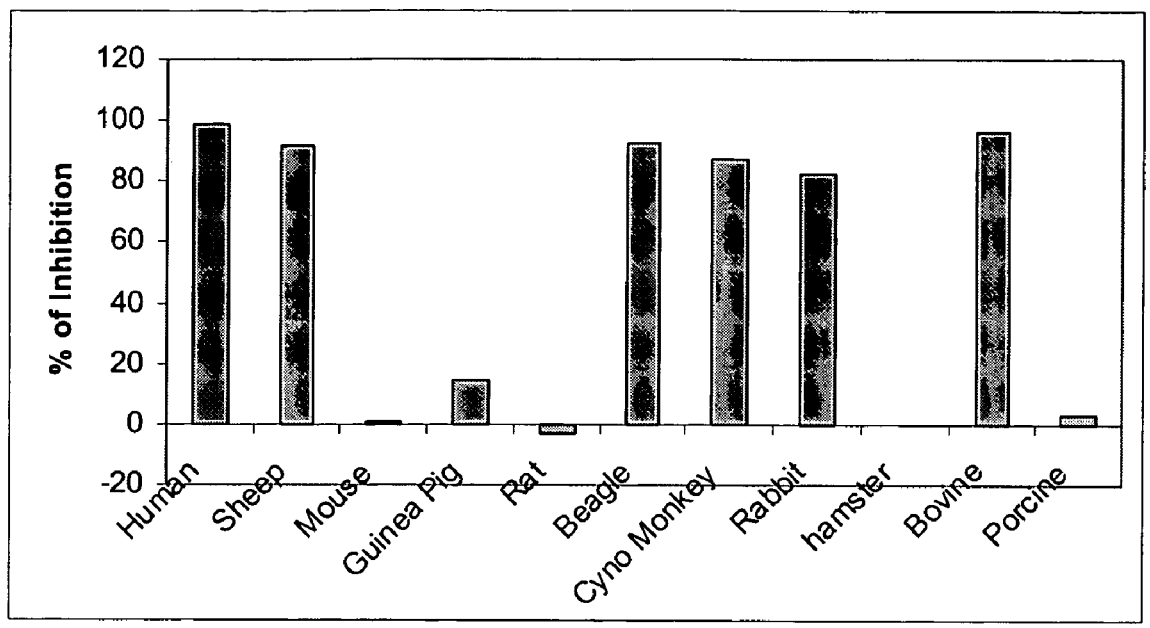
FIG. 5. DX-2300 inhibition of kallikrein-like activity in animal urine. Kallikrein-like activity in animal was measured as described above. The percent inhibition is ratio of the initial rate observed in the presence of DX-2300 ($R_{inhibited}$) to that observed in its absence ($R_0$) such that Percent Inhibition=$100-(R_0-R_{inhibited})/R_0*100$.
Figure 6:
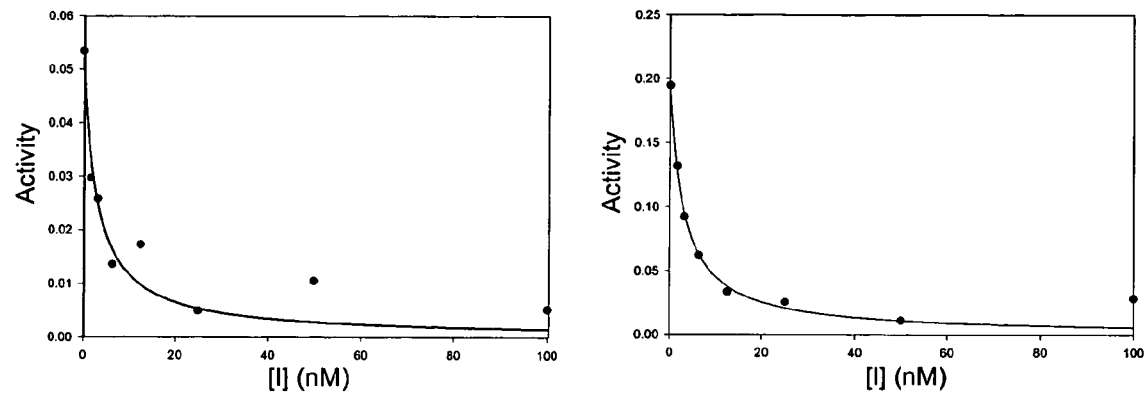
FIG. 6. Determination of DX-2300 $IC_{50}$ of kallikrein-like activity in human and sheep urine. Measurements of kallikrein activity in activated urine were performed as described above in the presence or absence of a varied concentration of DX-2300. The measured DX-2300 $IC_{50}$ values for kallikrein-like activity in sheep urine and human urine are comparable at 2.9±1.6 nM and 3.0±0.6 nM, respectively.

From FIG. 5, it is evident that DX-2300 inhibits the kallikrein-like activity present in the urine of humans, sheep, dogs, monkeys, rabbits, and cows. However, it does not inhibit the kallikrein-like activity observed in rodents (mice, rats, guinea pigs, or hamsters) or from pig urine. The measured DX-2300 $IC_{50}$ values for kallikrein-like activity in sheep urine and human urine are comparable at 2.9±1.6 nM and 3.0±0.6 nM, respectively (FIG. 6)

Procedure. Animal urine was first buffered by the addition of a ¹⁄₁₀ volume of 1 M HEPES, pH 7.7 and centrifuged to remove solids. The supernatant (1 mL) was then activated by the addition of 50 µL trypsin agarose resin for 30 minutes at 37° C. The sample was then centrifuged to remove the trypsin agarose and any residual trypsin that may have leached from the resin was inactivated with 10 µM soybean trypsin inhibitor. The kallikrein activity towards the synthetic substrate Pro-Phe-Arg-AMC (100 µM [final]) in activated urine (9 µL) was measured in Kal buffer (Table 4) wells of a 96 well plate (100 µL total volume) in the presence or absence of 0.5 µM DX-2300. Activated urine was first incubated with DX-2300 for 30 minutes at 37° C. prior to the addition of substrate.

Inhibition of Kallikrein-Like Activity in Human Bronchial Alveolar Lavage

Figure 7:
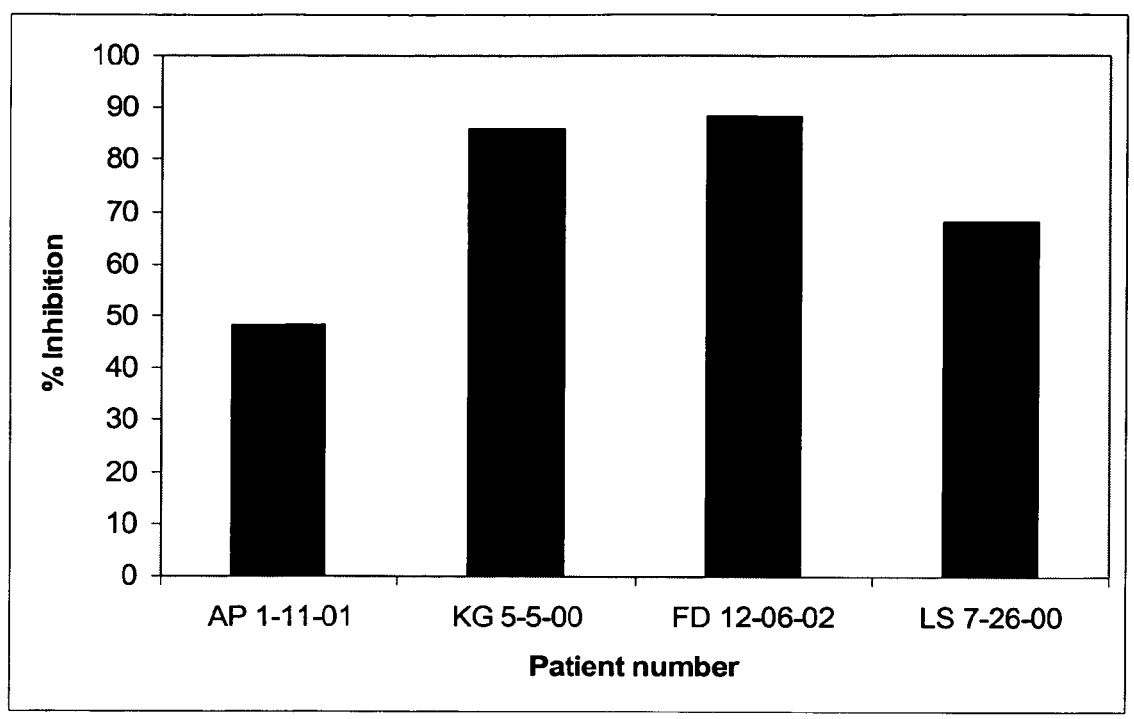
FIG. 7. Inhibition of kallikrein-like activity in human BAL from mild asthmatic patients following a rhinovirus infection. Kallikrein activity in BAL was measured in 80 µL BAL using 100 µM Pro-Phe-Arg-AMC substrate in KAL buffer (Table 4) in the presence or absence of 0.5 µM DX-2300. Prior to the addition of substrate the BAL was incubated with DX-2300 for 30 minutes at 30° C.

Tissue kallikrein 1 (hK1) has been shown to be elevated in the airways of asthmatic patients compared to healthy individuals as measured in bronchial alveolar lavage (BAL). Proud, D. et al. *Am J Respir Cell Mol Biol*, 1993. 8(1):16-19; Christiansen, S. C., et al., *Am Rev Respir Dis*, 1992. 145(4 Pt 1):900-905; Christiansen, S. C., et al., *J Clin Invest*, 1987. 79(1): 188-197. DX-2300 was found to inhibit kallikrein-like activity in BAL from 4 different mildly asthmatic patients as measured using the synthetic substrate, Pro-Phe-Arg-AMC. (See FIG. 7)This synthetic substrate can be be hydrolyzed by other proteases in the BAL and is therefore not a selective substrate of kininogenase activity. Because DX-2300 has been shown to be a highly specific inhibitor of K1, it is unlikely to inhibit these other proteases in the BAL. Consequently, DX-2300 is not expected to completely inhibit the protease activity in BAL. The observation of a substantial amount of protease inhibition in BAL with such a specific inhibitor of K1 activity does confirm K1 activity is elevated from asthmatic patients.

Effect of DX-2300 in Sheep Model of Asthma

Figure 8:
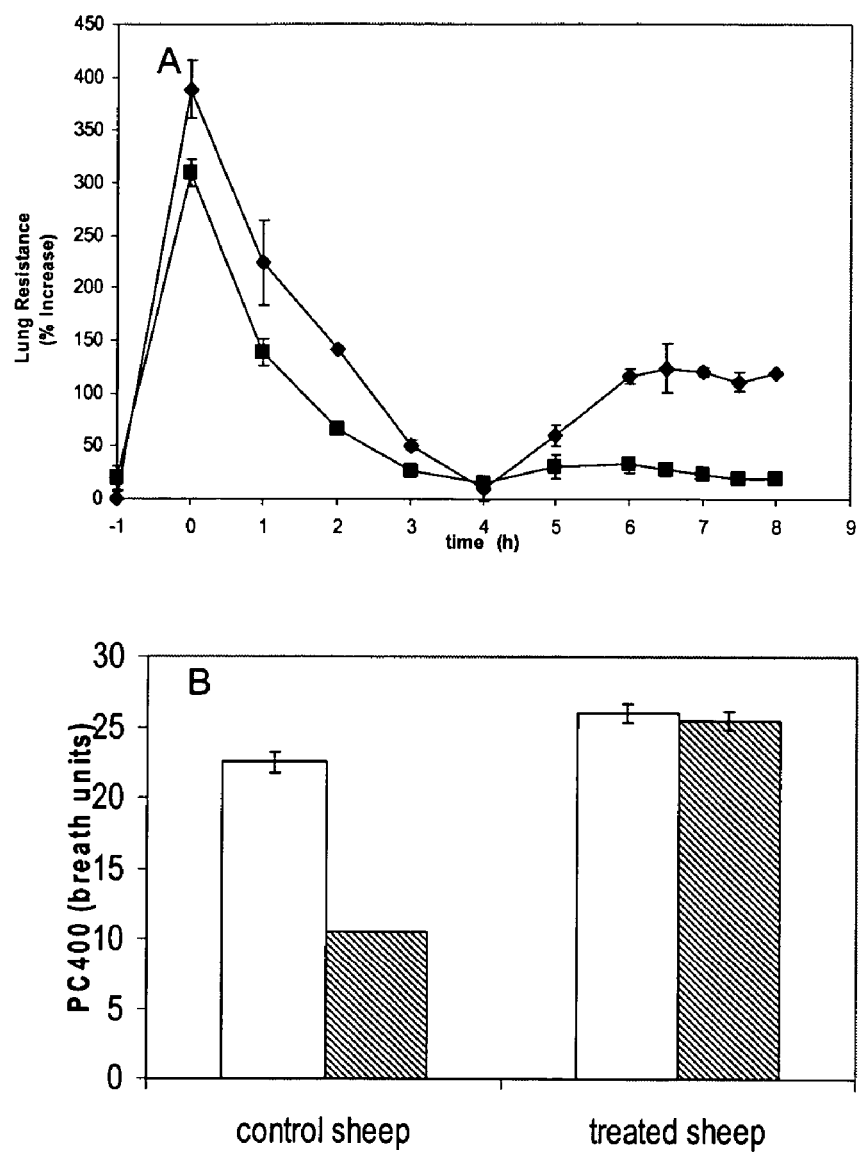
FIG. 8. Effect of DX-2300 on antigen-induced airway responses in the sheep. Sheep (n=2) were administered 10 mg of DX-2300 by inhalation 12 hours and 30 minutes prior to challenge with the *Ascaris suum* allergen. Panel A compares DX-2300 treated animals (squares) to control animals (diamonds) by measuring pulmonary resistance over 8 hours following allergen challenge. Panel B compares the airway hyper-responsiveness to carbachol administered 24 hours post challenge observed in DX-2300 treated animals to control animals. The open bars indicate the amount of carbachol required to induce bronchoconstriction 400% above baseline prior to allergen challenge. The filled bars indicate the amount of carbachol required to induce bronchoconstriction 400% above baseline 24 hours after allergen challenge.

The sheep model of asthma has been previously used to validate potential asthma drug targets and test agents. Forteza, R., et al., *Am J Respir Crit Care Med*, 1996. 154(1):36-42; Rosen, S. D., et al., *Am J Pathol*, 2005. 166(3):935-944; Scuri, M., et al., *J Appl Physiol*, 2002. 93(6): 1900-1906. In this model allergic sheep are challenged with *Ascaris suum* antigen and measurements of pulmonary resistence provide an indication of the accompanying bronchoconstriction. As shown in FIG. 8A, DX-2300 slightly decreased early phase and inhibited the late phase bronchoconstriction by over 80%.

Figure 9:
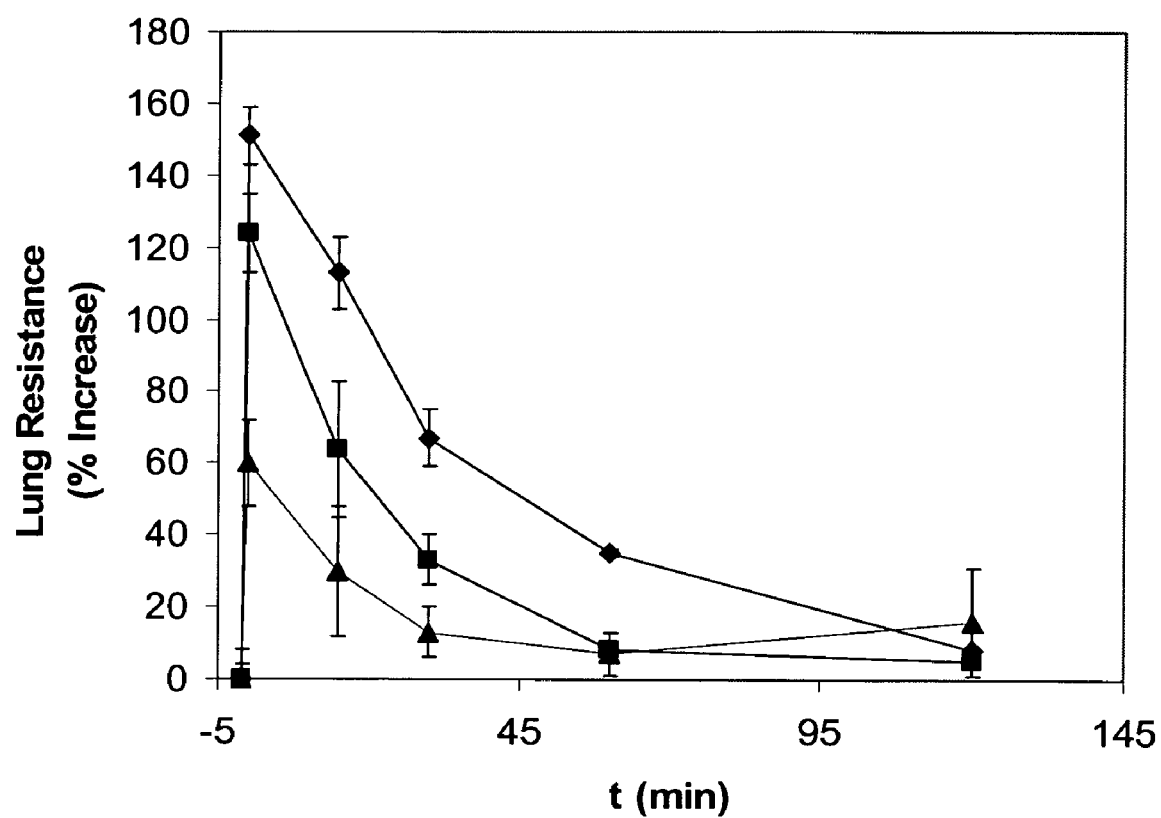
FIG. 9. Effect of DX-2300 on high molecular weight kininogen induced bronchoconstriction in the sheep model of asthma. The diamond symbols show bronchoconstriction in response to inhaled HMWK (100 µg) in the absence of drug. The square symbols show bronchoconstriction in response to inhaled HMWK (100 µg) in the presence of 1 mg DX-2300 inhaled. The triangles show bronchoconstriction in response to inhaled HMWK (100 µg) in the presence of 5 mg DX-2300.

Measurements of the airway hyper-responsiveness (AHR) in the sheep model of asthma also indicate efficacy in human patients. As shown in FIG. 9B, DX-2300 completely blocked the AHR that follows allergen challenge. AHR is measured according to how much carbachol, a chlolinergic agonist, is required to increase bronchoconstriction 400% above baseline (PC400). Following allergen challenge the airways are hyper-responsive to such an agonist so the amount require to induce the same level of bronchoconstriction is reduced. FIG. 9B demonstrates that DX-2300 blocked the development of AHR because the same amount of carbachol was required after challenge to reach the PC400 level of bronchoconstriction.

Administration of high molecular weight kininogen (HMWK), a K1 substrate, to sheep by inhalation results in an immediate bronchoconstriction, as measured by an increase in lung resistance. This increase is due to the generation of kinins by the airway kininogenase. The observation that DX-2300 inhibits HMWK-induced bronchoconstriction (FIG. 10) supports the observation that K1 is the major kininogenase in the airway. Christiansen, S. C., et al., *Am Rev Respir Dis*, 1992. 145(4 Pt 1):900-905; Lauredo, I. T., et al., *Am J Physiol Lung Cell Mol Physiol*, 2004. 286(4):L734-40.

Codon Optimization of DNA Encoding the Heavy and Light Chains of DX-2300

DNA encoding the heavy and light chains of DX-2300 were both optimized for expression in Chinese hamster ovary (CHO) cells by GENEART, experts in fie, using a proprietary algorithm. During the optimization of the codon usage was adapted to the codon bias of Cricetulus genes. Regions of high (>80%) or low (<30%) GC content where avoided where possible. In addition, for the heavy chain 4 Procarya inhibitory motifs and 7 consensus cryptic splice donor sites were removed. For the light chain, the single intron was removed.

```
Optimized DX-2300 light chain (SEQ ID NO:145)
AAGCTTATGGGCTGGTCCTGTATCATCCTGTTTCTGGTGGCCACCGCCAC
CTCTGGCGTGAACTCCTCCAGACTGGAGGTGTGGACCTACATCTGGGTGA
CCATGACCTCCACCCTGCCTTTCTCTCCAGGCGTGCACTCCGACATCCAG
ATGACCCAGTCCCCCTCTTCTCTGTCTGCCTCTGTGGGCGACAGAGTGAC
CATCACCTGTCGGGCCTCCCAGTCCATCTCCTCCTACCTGAACTGGTATC
AGCAGAAGCCTGGCAAGGCTCCCAAGCTGCTGATCTACGCCGCTTCCTCT
CTGCAGTCTGGCGTGCCTTCCAGATTCTCCGGCTCTGGCTCTGGCACCGA
TTTCACCCTGACCATCTCCAGCCTGCAGCCTGAGGATTTCGCCACCTACT
ACTGCCAGCAGTCCTACTCTACCCCTCTGACCTTTGGCGGCGGAACAAAG
GTGGAGATCAAGAGGACCGTGGCCGCTCCTTCCGTGTTCATCTTCCCCCC
TTCCGACGAGCAGCTGAAGTCTGGCACCGCCTCTGTGGTGTGTCTGCTGA
ACAACTTCTACCCCCGGGAGGCCAAGGTGCAGTGGAAGGTGGACAACGCC
CTGCAGTCCGGCAATTCCCAGGAGTCTGTGACCGAGCAGGACTCCAAGGA
CAGCACCTACTCCCTGTCCTCTACCCTGACCCTGTCCAAGGCCGACTACG
AGAAGCACAAGGTGTACGCCTGTGAGGTGACCCACCAGGGCCTGTCTAGC
CCTGTGACCAAGTCCTTCAACCGGGGCGAGTGCTGATGAGAATTC
```

```
Optimized DX-2300 Heavy Chain (SEQ ID NO:146
AAGCTTATGGGCTGGTCCTGTATCATCCTGTTTCTGGTGGCCACCGCCAC
CGGCGCTCACTCTGAGGTGCAGCTGCTGGAGTCTGGCGGCGGACTGGTGC
AGCCTGGCGGCTCTCTGAGACTGTCTTGTGCCGCCTCCGGCTTCACCTTC
TCCAAGTACAAGATGGTGTGGGTGAGGCAGGCCCCTGGCAAGGGCCTGGA
GTGGGTGTCCTCCATCTACCCATCTGGCGGCATCACCGCCTACGCCGATT
CTGTGAAGGGCCGGTTCACCATCTCCCGGGACAACTCCAAGAACACCCTG
TACCTGCAGATGAACTCCCTGAGAGCCGAGGATACCGCCATGTACTACTG
TGCCAAGGACATCACCCCTGGCGGAGGATCTGGCTTCCGGCTGCCCAAGA
ATTACTACTACTACGGCATGGATGTGTGGGGCCAGGGCACCACCGTGACC
GTGTCCTCTGCTTCTACCAAGGGCCCTTCCGTGTTTCCTCTGGCCCCTTC
CTCCAAGTCTACCTCCGGCGGCACCGCCGCTCTGGGCTGCCTGGTGAAGG
ACTACTTCCCTGAGCCCGTGACAGTGTCTTGGAACTCTGGCGCTCTGACC
TCTGGCGTGCACACCTTCCCTGCTGTGCTGCAGTCCTCCGGCCTGTACTC
TCTGTCCTCCGTGGTGACCGTGCCTTCTTCTTCTCTGGGCACCCAGACCT
ACATCTGTAACGTGAACCACAAGCCCTCCAACACCAAGGTGGACAAGCGG
GTGGAGCCTAAGTCCTGTGACAAGACCCACACCTGCCCTCCCTGTCCTGC
CCCTGAGCTGCTGGGCGGACCTTCTGTGTTCCTGTTCCCCCCCAAGCCTA
AGGACACCCTGATGATCTCCAGGACCCCTGAGGTGACCTGTGTGGTGGTG
GACGTGTCTCACGAGGATCCCGAGGTGAAGTTCAACTGGTACGTGGACGG
CGTGGAGGTGCACAACGCCAAGACCAAGCCTAGGGAGGAGCAGTACAACT
CCACCTACCGGGTGGTGTCTGTGCTGACCGTGCTGCACCAGGATTGGCTG
AACGGCAAGGAATACAAGTGTAAGGTGTCCAACAAGGCCCTGCCTGCCCC
CATCGAGAAAACCATCTCCAAGGCCAAGGGCCAGCCTCGGGAGCCTCAGG
TGTACACCCTGCCTCCTAGCAGGGAGGAGATGACCAAGAACCAGGTGTCC
CTGACCTGTCTGGTGAAGGGCTTCTACCCTTCCGATATCGCCGTGGAGTG
GGAGTCTAATGGCCAGCCCGAGAACAACTACAAGACCACCCCTCCTGTGC
TGGACTCTGACGGCTCCTTCTTCCTGTACTCCAAGCTGACCGTGGACAAG
TCCAGATGGCAGCAGGGCAACGTGTTCTCCTGCTCCGTGATGCACGAGGC
CCTGCACAATCACTACACCCAGAAGTCCCTGTCTCTGTCCCCCGGCAAGT
GATGAGAATTC
```

Those skilled in the art will recognize, or be able to ascertain using no more than routine experimentation, many equivalents of the specific embodiments of the invention described herein. Such equivalents are intended to be encompassed by the following claims.

SEQUENCE LISTING (1296 sequences)

SEQ ID NO: 1 - protein, 14 aa, Artificial Sequence
  Synthetically generated peptide
TGTSSDIGAYNYVS

SEQ ID NO: 2 - protein, 7 aa, Artificial Sequence
  Synthetically generated peptide
DVSNRPS

SEQ ID NO: 3 - protein, 9 aa, Artificial Sequence
  Synthetically generated peptide
SSYRSSSLM

SEQ ID NO: 4 - protein, 5 aa, Artificial Sequence
  Synthetically generated peptide
HYVMS

SEQ ID NO: 5 - protein, 17 aa, Artificial Sequence
  Synthetically generated peptide
YIYPSGGKTHYADSVKG

SEQ ID NO: 6 - protein, 9 aa, Artificial Sequence
  Synthetically generated peptide
VGVWYGMDV

SEQ ID NO: 7 - protein, 11 aa, Artificial Sequence
  Synthetically generated peptide
RASQSISSYLN

SEQ ID NO: 8 - protein, 7 aa, Artificial Sequence
  Synthetically generated peptide
AASSLQS

SEQ ID NO: 9 - protein, 9 aa, Artificial Sequence
  Synthetically generated peptide
QQSYSTPLT

SEQ ID NO: 10 - protein, 5 aa, Artificial Sequence
  Synthetically generated peptide
KYKMV

SEQ ID NO: 11 - protein, 17 aa, Artificial Sequence
  Synthetically generated peptide
SIYPSGGITAYADSVKG

SEQ ID NO: 12 - protein, 23 aa, Artificial Sequence
  Synthetically generated peptide
DITPGGGSGFRLPKNYYYYGMDV

SEQ ID NO: 13 - protein, 11 aa, Artificial Sequence
  Synthetically generated peptide
RASQGISSWLA

SEQ ID NO: 14 - protein, 7 aa, Artificial Sequence
  Synthetically generated peptide
AASSLER

SEQ ID NO: 15 - protein, 9 aa, Artificial Sequence
  Synthetically generated peptide
QQYHNFPLT

SEQ ID NO: 16 - protein, 5 aa, Artificial Sequence
  Synthetically generated peptide
YYEME

SEQ ID NO: 17 - protein, 17 aa, Artificial Sequence
  Synthetically generated peptide
SIRPSGGRTVYADSVKG

SEQ ID NO: 18 - protein, 18 aa, Artificial Sequence
  Synthetically generated peptide
GRSNYYGSGSYSPKYFQH

SEQ ID NO: 19 - protein, 12 aa, Artificial Sequence
  Synthetically generated peptide
RASQSVSSNYLS

SEQ ID NO: 20 - protein, 7 aa, Artificial Sequence
  Synthetically generated peptide
GTSNRAS

SEQ ID NO: 21 - protein, 10 aa, Artificial Sequence
  Synthetically generated peptide
QQYGGAPLFI

SEQ ID NO: 22 - protein, 5 aa, Artificial Sequence
  Synthetically generated peptide
HYNMN

SEQ ID NO: 23 - protein, 17 aa, Artificial Sequence
  Synthetically generated peptide
VIYPSGGQTHYADSVKG

SEQ ID NO: 24 - protein, 9 aa, Artificial Sequence
  Synthetically generated peptide
RGIWHSFDI

SEQ ID NO: 25 - protein, 13 aa, Artificial Sequence
  Synthetically generated peptide
SGTNSNIGSNSVF

SEQ ID NO: 26 - protein, 7 aa, Artificial Sequence
  Synthetically generated peptide
RNSQRPS

SEQ ID NO: 27 - protein, 11 aa, Artificial Sequence
  Synthetically generated peptide
ATWDDSLRSPV

SEQ ID NO: 28 - protein, 5 aa, Artificial Sequence
  Synthetically generated peptide
RYSMT

SEQ ID NO: 29 - protein, 17 aa, Artificial Sequence
  Synthetically generated peptide
SIYPSGGKTTYADSVKG

SEQ ID NO: 30 - protein, 20 aa, Artificial Sequence
  Synthetically generated peptide
MVAPYYYDSSGYPPAEYFQH

SEQ ID NO: 31 - protein, 5 aa, Artificial Sequence
  Synthetically generated peptide
  VARIANT 1: Xaa = Lys or His
  VARIANT 3: Xaa = Lys, Val or Ser
  VARIANT 5: Xaa = Val, Ile or Thr
XYXMX

SEQ ID NO: 32 - protein, 17 aa, Artificial Sequence
  Synthetically generated peptide
  VARIANT 1: Xaa = Ser, Trp or Arg
  VARIANT 8: Xaa = Ile Asn or Arg
  VARIANT 10: Xaa = Ala, Ile or Gly
XIYPSGGXTXYADSVKG

SEQ ID NO: 33 - protein, 9 aa, Artificial Sequence
  Synthetically generated peptide
QQSYSTPRT

SEQ ID NO: 34 - protein, 5 aa, Artificial Sequence
  Synthetically generated peptide
LYFMT

SEQ ID NO: 35 - protein, 17 aa, Artificial Sequence
  Synthetically generated peptide
SISSSGGSTKYADSVKG

SEQ ID NO: 36 - protein, 9 aa, Artificial Sequence
  Synthetically generated peptide
GGQWLAFDY

SEQ ID NO: 37 - protein, 14 aa, Artificial Sequence
  Synthetically generated peptide
TGTSSDVGSYKLVS

SEQ ID NO: 38 - protein, 7 aa, Artificial Sequence
  Synthetically generated peptide
EGSKRPS

SEQ ID NO: 39 - protein, 10 aa, Artificial Sequence
  Synthetically generated peptide
CSYAGSSTWV

SEQ ID NO: 40 - protein, 5 aa, Artificial Sequence
  Synthetically generated peptide
HYAMD

SEQ ID NO: 41 - protein, 17 aa, Artificial Sequence
  Synthetically generated peptide
VIYSSGGKTTYADSVKG

SEQ ID NO: 42 - protein, 29 aa, Homo sapiens
EVQLVESGGGLVQPGGSLRLSCAASGFTF

SEQ ID NO: 43 - protein, 29 aa, Homo sapiens
EVQLVESGGGLVQPGRSLRLSCAASGFTF

SEQ ID NO: 44 - protein, 29 aa, Homo sapiens
QVQLVESGGGLVKPGGSLRLSCAASGFTF

SEQ ID NO: 45 - protein, 9 aa, Artificial Sequence
  Synthetically generated peptide
QQANSFPHT

SEQ ID NO: 46 - protein, 5 aa, Artificial Sequence
  Synthetically generated peptide
FYLMF

SEQ ID NO: 47 - protein, 17 aa, Artificial Sequence
  Synthetically generated peptide
GIYPSGGQTVYADSVKG

SEQ ID NO: 48 - protein, 8 aa, Artificial Sequence
  Synthetically generated peptide
AIGAGSSF

SEQ ID NO: 49 - protein, 11 aa, Artificial Sequence
  Synthetically generated peptide
RASRGISNWLA

SEQ ID NO: 50 - protein, 7 aa, Artificial Sequence
  Synthetically generated peptide
SASTLHA

SEQ ID NO: 51 - protein, 9 aa, Artificial Sequence
  Synthetically generated peptide
QEGNSFPYT

SEQ ID NO: 52 - protein, 5 aa, Artificial Sequence
  Synthetically generated peptide
WYSMN

SEQ ID NO: 53 - protein, 17 aa, Artificial Sequence
  Synthetically generated peptide
SIGPSGGGTKYADSVKG

SEQ ID NO: 54 - protein, 16 aa, Artificial Sequence
  Synthetically generated peptide
RGQRKQWLPPNGAFDI

SEQ ID NO: 55 - protein, 11 aa, Artificial Sequence
  Synthetically generated peptide
WTIYDISSWLA

SEQ ID NO: 56 - protein, 7 aa, Artificial Sequence
  Synthetically generated peptide
AASRLAT

SEQ ID NO: 57 - protein, 9 aa, Artificial Sequence
  Synthetically generated peptide
QQTKDFPLT

SEQ ID NO: 58 - protein, 5 aa, Artificial Sequence
  Synthetically generated peptide
RYGMQ

SEQ ID NO: 59 - protein, 17 aa, Artificial Sequence
  Synthetically generated peptide
YIYPSGGGTVYADSVKG

SEQ ID NO: 60 - protein, 17 aa, Artificial Sequence
  Synthetically generated peptide
RVAVAGSWYYYYYGMDV

SEQ ID NO: 61 - protein, 13 aa, Artificial Sequence
  Synthetically generated peptide
SGSSSNIGSNYVY

SEQ ID NO: 62 - protein, 7 aa, Artificial Sequence
  Synthetically generated peptide
RNNQRPS

SEQ ID NO: 63 - protein, 11 aa, Artificial Sequence
  Synthetically generated peptide
AAWDDSLSGVV

SEQ ID NO: 64 - protein, 5 aa, Artificial Sequence
  Synthetically generated peptide
AYLMA

SEQ ID NO: 65 - protein, 17 aa, Artificial Sequence
  Synthetically generated peptide
SIRPSGGETRYADSVKG

SEQ ID NO: 66 - protein, 22 aa, Artificial Sequence
  Synthetically generated peptide
DQKGYPDSSSFRRYYYYYGMDV

SEQ ID NO: 67 - protein, 14 aa, Artificial Sequence
  Synthetically generated peptide
TGTNTDVGGYNLVS

SEQ ID NO: 68 - protein, 7 aa, Artificial Sequence
  Synthetically generated peptide
EVSNRPS

SEQ ID NO: 69 - protein, 10 aa, Artificial Sequence
  Synthetically generated peptide
GSYTSSSTHV

SEQ ID NO: 70 - protein, 5 aa, Artificial Sequence
  Synthetically generated peptide
WYVMT

SEQ ID NO: 71 - protein, 17 aa, Artificial Sequence
  Synthetically generated peptide
VIYPSGGATKYADSVKG

SEQ ID NO: 72 - protein, 8 aa, Artificial Sequence
  Synthetically generated peptide
RGAGGMDV

SEQ ID NO: 73 - protein, 11 aa, Artificial Sequence
  Synthetically generated peptide
RASHVINIDLG

SEQ ID NO: 74 - protein, 7 aa, Artificial Sequence
  Synthetically generated peptide
GASHLQR

SEQ ID NO: 75 - protein, 9 aa, Artificial Sequence
  Synthetically generated peptide
LQDSFYPRT

SEQ ID NO: 76 - protein, 5 aa, Artificial Sequence
  Synthetically generated peptide
NYSMQ

SEQ ID NO: 77 - protein, 17 aa, Artificial Sequence
  Synthetically generated peptide
SIGPSGGRTWYADSVKG

SEQ ID NO: 78 - protein, 29 aa, Homo sapiens
EVQLVESGGGVVRPGGSLRLSCAASGFTF

SEQ ID NO: 79 - protein, 11 aa, Artificial Sequence
  Synthetically generated peptide
RASQDIASWLA

SEQ ID NO: 80 - protein, 29 aa, Homo sapiens
EVQLVESGGGLVKPGGSLRLSCAASGFTF

SEQ ID NO: 81 - protein, 9 aa, Artificial Sequence
  Synthetically generated peptide
QQANSFPFT

SEQ ID NO: 82 - protein, 5 aa, Artificial Sequence
  Synthetically generated peptide
PYKMG

SEQ ID NO: 83 - protein, 17 aa, Artificial Sequence
  Synthetically generated peptide
SIYPSGGVTTYADSVKG

SEQ ID NO: 84 - protein, 15 aa, Artificial Sequence
  Synthetically generated peptide
NINLRYDILTGYFDI

SEQ ID NO: 85 - protein, 11 aa, Artificial Sequence
  Synthetically generated peptide
RASQGISSWLV

SEQ ID NO: 86 - protein, 29 aa, Homo sapiens
EVQLLESGGGLVQPGGSLRLSCAASGFTF

SEQ ID NO: 87 - protein, 9 aa, Artificial Sequence
  Synthetically generated peptide
QQAKTFPLT

SEQ ID NO: 88 - protein, 5 aa, Artificial Sequence
  Synthetically generated peptide
HYMMH

SEQ ID NO: 89 - protein, 17 aa, Artificial Sequence
  Synthetically generated peptide
GIGPSGGKTPYADSVKG

SEQ ID NO: 90 - protein, 29 aa, Homo sapiens
QVQLVESGGGVVQPGRSLRLSCAASGFTF

SEQ ID NO: 91 - protein, 11 aa, Artificial Sequence
  Synthetically generated peptide
RASQSVSSYLA

SEQ ID NO: 92 - protein, 5 aa, Artificial Sequence
  Synthetically generated peptide
DNRAT

SEQ ID NO: 93 - protein, 9 aa, Artificial Sequence
  Synthetically generated peptide
QQRSNWLWT

SEQ ID NO: 94 - protein, 5 aa, Artificial Sequence
  Synthetically generated peptide
HYVMQ

SEQ ID NO: 95 - protein, 17 aa, Artificial Sequence
  Synthetically generated peptide
GIGPSGGSTTYADSVKG

SEQ ID NO: 96 - protein, 29 aa, Homo sapiens
QVQLVESGGGVVQPGRSLRLSCAASGFTF

SEQ ID NO: 97 - protein, 14 aa, Artificial Sequence
  Synthetically generated peptide
TGTSSDVGAYNYVS

SEQ ID NO: 98 - protein, 7 aa, Artificial Sequence
  Synthetically generated peptide
EVNKRPS

SEQ ID NO: 99 - protein, 10 aa, Artificial Sequence
  Synthetically generated peptide
NSYAGSNSLI

SEQ ID NO: 100 - protein, 5 aa, Artificial Sequence
  Synthetically generated peptide
HYSMF

SEQ ID NO: 101 - protein, 17 aa, Artificial Sequence
  Synthetically generated peptide
SIYPSGGQTDYADSVKG

SEQ ID NO: 102 - protein, 9 aa, Artificial Sequence
  Synthetically generated peptide
RGLLWSFDS

SEQ ID NO: 103 - protein, 29 aa, Homo sapiens
QVQLVESGGGVVQPGRSLRLSCAASGFTF

SEQ ID NO: 104 - protein, 29 aa, Homo sapiens
QVQLVESGGGVVQPGRSLRLSCAASGFTF

SEQ ID NO: 105 - protein, 29 aa, Homo sapiens
EVQLVESGGVVVQPGGSLRLSCAASGFTF

SEQ ID NO: 106 - protein, 5 aa, Artificial Sequence
  Synthetically generated peptide
YYQMS

SEQ ID NO: 107 - protein, 17 aa, Artificial Sequence
  Synthetically generated peptide
RIGPSGGLTSYADSVKG

SEQ ID NO: 108 - protein, 14 aa, Homo sapiens
WVRQAPGKGLEWVA

SEQ ID NO: 109 - protein, 14 aa, Homo sapiens
WVRQAPGKGLEWVS

SEQ ID NO: 110 - protein, 14 aa, Homo sapiens
WIRQAPGKGLEWVS

SEQ ID NO: 111 - protein, 11 aa, Artificial Sequence
  Synthetically generated peptide
QQRSNWPSPIA

SEQ ID NO: 112 - protein, 5 aa, Artificial Sequence
  Synthetically generated peptide
HYVMI

SEQ ID NO: 113 - protein, 17 aa, Artificial Sequence
  Synthetically generated peptide
WIYPSGGNTIYADSVKG

SEQ ID NO: 114 - protein, 32 aa, Homo sapiens
RFTISRDNAKNSLYLQMNSLRAEDTAVYYCAR

SEQ ID NO: 115 - protein, 11 aa, Artificial Sequence
  Synthetically generated peptide
RASQGIRNDLG

SEQ ID NO: 116 - protein, 7 aa, Artificial Sequence
  Synthetically generated peptide
AASSLQS

SEQ ID NO: 117 - protein, 9 aa, Artificial Sequence
  Synthetically generated peptide
LQDYNYPRT

SEQ ID NO: 118 - protein, 5 aa, Artificial Sequence
  Synthetically generated peptide
RYFMI

SEQ ID NO: 119 - protein, 17 aa, Artificial Sequence
  Synthetically generated peptide
SIVPSGGPTRYADSVKG

SEQ ID NO: 120 - protein, 18 aa, Artificial Sequence
  Synthetically generated peptide
RGPVYYYDSSGSHSAFDI

SEQ ID NO: 121 - protein, 13 aa, Artificial Sequence
  Synthetically generated peptide
SGSNSNIGNNFVY

SEQ ID NO: 122 - protein, 33 aa, Homo sapiens
RFTISRDNAKNSLYLQMNSLRAEDTALYYCAKD

SEQ ID NO: 123 - protein, 11 aa, Artificial Sequence
  Synthetically generated peptide
AAWDDSLSGVL

SEQ ID NO: 124 - protein, 5 aa, Artificial Sequence
  Synthetically generated peptide
RYHMS

SEQ ID NO: 125 - protein, 17 aa, Artificial Sequence
  Synthetically generated peptide
SIRPSGGSTIYADSVKG

SEQ ID NO: 126 - protein, 18 aa, Artificial Sequence
  Synthetically generated peptide
EPRRYYYDSSGSYDAFDI

SEQ ID NO: 127 - protein, 32 aa, Homo sapiens
RFTISRDNAKNSLYLQMNSLRAEDTALYHCAR

SEQ ID NO: 128 - protein, 7 aa, Artificial Sequence
  Synthetically generated peptide
GASSRAT

SEQ ID NO: 129 - protein, 9 aa, Artificial Sequence
  Synthetically generated peptide
QQRGGWPLT

SEQ ID NO: 130 - protein, 5 aa, Artificial Sequence
  Synthetically generated peptide
KYPMT

SEQ ID NO: 131 - protein, 17 aa, Artificial Sequence
  Synthetically generated peptide
SISSSGGKTQYADSVKG

SEQ ID NO: 132 - protein, 11 aa, Artificial Sequence
  Synthetically generated peptide
GGSSTLYFMDV

SEQ ID NO: 133 - protein, 13 aa, Artificial Sequence
  Synthetically generated peptide
SGSSSNIGSNYVH

SEQ ID NO: 134 - protein, 7 aa, Artificial Sequence
  Synthetically generated peptide
RNNRRPS

SEQ ID NO: 135 - protein, 12 aa, Artificial Sequence
  Synthetically generated peptide
AAWDDSLSGLVV

SEQ ID NO: 136 - protein, 5 aa, Artificial Sequence
  Synthetically generated peptide
PYQMW

SEQ ID NO: 137 - protein, 17 aa, Artificial Sequence
  Synthetically generated peptide
SISSSGGLTRYADSVKG

SEQ ID NO: 138 - protein, 18 aa, Artificial Sequence
  Synthetically generated peptide
VKLNYYGSGSYSLDAFDI

SEQ ID NO: 139 - protein, 32 aa, Homo sapiens
RFTISRDNSKNTLYLQMNSLRAEDTAVYYCAK

SEQ ID NO: 140 - protein, 32 aa, Homo sapiens
RFTISRDNSKNTLYLQMNSLRAEDTAVYYCAR

SEQ ID NO: 141 - protein, 9 aa, Artificial Sequence
  Synthetically generated peptide
QQSYNAPWT

SEQ ID NO: 142 - protein, 5 aa, Artificial Sequence
  Synthetically generated peptide
RYVMS

SEQ ID NO: 143 - protein, 17 aa, Artificial Sequence
  Synthetically generated peptide
SIRSSGGRTMYADSVKG

SEQ ID NO: 144 - protein, 33 aa, Homo sapiens
  Synthetically generated peptide
RFTISRDNSKNSLYLQMNSLRTEDTALYYCAKD

SEQ ID NO: 145 - DNA, 795 bp, Artificial Sequence
  Synthetically generated oligonucleotide
aagcttatgggctggtcctgtatcatcctgtttctggtggccaccgccacctctggcgtgaactcctccagactggaggtgtggacctacatctgggtgaccatgacctccaccctgcctttctctccaggcgtgcactccgacatccagatgacccagtccccctcttctctgtctgcctctgtgggcgacagagtgaccatcacctgtcgggcctcccagtccatctcctcctacctgaactggtatcagcagaagcctggcaaggctcccaagctgctgatctacgccgcttcctctctgcagtctggcgtgccttccagattctccggctctggctctggcaccgatttcaccctgaccatctccagcctgcagcctgaggatttcgccacctactactgccagcagtcctactctacccctctgacctttggcggcggaacaaaggtggagatcaagaggaccgtggccgctccttccgtgttcatcttccccccttccgacgagcagctgaagtctggcaccgcctctgtggtgtgtctgctgaacaacttctacccccgggaggccaaggtgcagtggaaggtggacaacgccctgcagtccggcaattcccaggagtctgtgaccgagcaggactccaaggacagcacctactccctgtcctctaccctgaccctgtccaaggccgactacgagaagcacaaggtgtacgcctgtgaggtgacccaccagggcctgtctagccctgtgaccaagtccttcaaccggggcgagtgctgatgagaattc

SEQ ID NO: 146 - DNA, 1461 bp, Artificial Sequence
  Synthetically generated oligonucleotide
aagcttatgggctggtcctgtatcatcctgtttctggtggccaccgccaccggcgctcactctgaggtgcagctgctggagtctggcggcggactggtgcagcctggcggctctctgagactgtcttgtgccgcctccggcttcaccttctccaagtacaagatggtgtgggtgaggcaggcccctggcaagggcctggagtgggtgtcctccatctacccatctggcggcatcaccgcctacgccgattctgtgaagggccggttcaccatctcccgggacaactccaagaacaccctgtacctgcagatgaactccctgagagccgaggataccgccatgtactactgtgccaaggacatcacccctggcggaggatctggcttccggctgcccaagaattactactactacggcatggatgtgtggggccagggcaccaccgtgaccgtgtcctctgcttctaccaagggcccttccgtgtttcctctggccccttcctccaagtctacctccggcggcaccgccgctctgggctgcctggtgaaggactacttccctgagcccgtgacagtgtcttggaactctggcgctctgacctctggcgtgcacaccttccctgctgtgctgcagtcctccggcctgtactctctgtcctccgtggtgaccgtgccttcttcttctctgggcacccagacctacatctgtaacgtgaaccacaagccctccaacaccaaggtggacaagcgggtggagcctaagtcctgtgacaagacccacacctgccctccctgtcctgcccctgagctgctgggcggaccttctgtgttcctgttcccccccaagcctaaggacaccctgatgatctccaggacccctgaggtgacctgtgtggtggtggacgtgtctcacgaggatcccgaggtgaagttcaactggtacgtggacggcgtggaggtgcacaacgccaagaccaagcctagggaggagcagtacaactccacctaccgggtggtgtctgtgctgaccgtgctgcaccaggattggctgaacggcaaggaatacaagtgtaaggtgtccaacaaggccctgcctgcccccatcgagaaaaccatctccaaggccaagggccagcctcgggagcctcaggtgtacaccctgcctcctagcagggaggagatgaccaagaaccaggtgtccctgacctgtctggtgaagggcttctacccttccgatatcgccgtggagtgggagtctaatggccagcccgagaacaactacaagaccacccctcctgtgctggactctgacggctccttcttcctgtactccaagctgaccgtggacaagtccagatggcagcagggcaacgtgttctcctgctccgtgatgcacgaggccctgcacaatcactacacccagaagtccctgtctctgtcccccggcaagtgatgagaattc

SEQ ID NO: 147 - protein, 10 aa, Artificial Sequence
  Synthetically generated peptide
SSFTSRKTWV

SEQ ID NO: 148 - protein, 118 aa, Homo sapiens
AQSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGVVFGGGTKLTVLGQPKAAP

SEQ ID NO: 149 - protein, 17 aa, Artificial Sequence
  Synthetically generated peptide
YISPSGGATWYADSVKG

SEQ ID NO: 150 - protein, 20 aa, Artificial Sequence
  Synthetically generated peptide
PSRPRYYYDSSGYYSSAFDI

SEQ ID NO: 151 - protein, 12 aa, Artificial Sequence
  Synthetically generated peptide
RASQSVSSSYLA

SEQ ID NO: 152 - protein, 144 aa, Artificial Sequence
  Synthetically generated peptide
EVQLLESGGGLVQPGGSLRLSCAASGFTFSAYLMAWVRQAPGKGLEWVSSIRPSGGETRYADSVKGRFTISRDNSKNTLYLQMNSLRAEDTAVYYCTRDQKGYPDSSSFRRYYYYYGMDVWGQGTTVTVSSASTKGPSVFPLAP

SEQ ID NO: 153 - protein, 8 aa, Artificial Sequence
  Synthetically generated peptide
QQYGSSLT

SEQ ID NO: 154 - protein, 5 aa, Artificial Sequence
  Synthetically generated peptide
HYSMT

SEQ ID NO: 155 - protein, 17 aa, Artificial Sequence
  Synthetically generated peptide
RIYPSGGRTGYADSVKG

SEQ ID NO: 156 - protein, 11 aa, Artificial Sequence
  Synthetically generated peptide
DSGGYYYGMDV

SEQ ID NO: 157 - protein, 12 aa, Artificial Sequence
  Synthetically generated peptide
RASQSVSSSYLA

SEQ ID NO: 158 - protein, 218 aa, Artificial Sequence
  Synthetically generated peptide
AQYELTQPPSASGTPGQRVTISCSGSSSNIGSNYVYWYQQLPGTAPKLLIYRNNQRPSGVPDRFSGSKSGTSASLAISGLRSEDEADYYCAAWDDSLSGHAVFGGGTQLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPTECS

SEQ ID NO: 159 - protein, 9 aa, Artificial Sequence
  Synthetically generated peptide
QQSYRSPYT

SEQ ID NO: 160 - protein, 5 aa, Artificial Sequence
  Synthetically generated peptide
HYVMA

SEQ ID NO: 161 - protein, 17 aa, Artificial Sequence
  Synthetically generated peptide
RIGPSGGYTMYADSVKG

SEQ ID NO: 162 - protein, 213 aa, Artificial Sequence
  Synthetically generated peptide
AQSALTQPPSVSVAPGQTASISCSGNILDNSYASWFQQKPGQSPVMVIHRDNKRPSGIPERFSGSTSGNTATLTISGTQAVDEADYYCQAWDRTTGVFGTGTRLTVLRQPKAAPSVTLFPPSSEELQANKATLVCLISDFYPGAVTVAWKADSSPVKAGVETTTPSKQSNNKYAASSYLSLTPEQWKSHRSYSCQVMHEGSTVEKTVAPAECS

SEQ ID NO: 163 - protein, 11 aa, Artificial Sequence
  Synthetically generated peptide
RASQSIGASLN

SEQ ID NO: 164 - protein, 5 aa, Artificial Sequence
  Synthetically generated peptide
TNLQS

SEQ ID NO: 165 - protein, 8 aa, Artificial Sequence
  Synthetically generated peptide
QQNYRGRT

SEQ ID NO: 166 - protein, 5 aa, Artificial Sequence
  Synthetically generated peptide
HYNMG

SEQ ID NO: 167 - protein, 17 aa, Artificial Sequence
  Synthetically generated peptide
RIGSSGGKTAYADSVKG

SEQ ID NO: 168 - protein, 20 aa, Artificial Sequence
  Synthetically generated peptide
TNYDFWSGYLPNPNPYPLDY

SEQ ID NO: 169 - protein, 11 aa, Artificial Sequence
  Synthetically generated peptide
TGTSSDVNYVS

SEQ ID NO: 170 - protein, 7 aa, Artificial Sequence
  Synthetically generated peptide
AVTKRPS

SEQ ID NO: 171 - protein, 10 aa, Artificial Sequence
  Synthetically generated peptide
SSYAGSNNLV

SEQ ID NO: 172 - protein, 5 aa, Artificial Sequence
  Synthetically generated peptide
HYPMD

SEQ ID NO: 173 - protein, 17 aa, Artificial Sequence
  Synthetically generated peptide
YIGPSGGSTRYADSVKG

SEQ ID NO: 174 - protein, 6 aa, Artificial Sequence
  Synthetically generated peptide
HVPPGT

SEQ ID NO: 175 - protein, 217 aa, Artificial Sequence
  Synthetically generated peptide
AQSALTQPASVSGSPGQSITISCTGTSNDIGRTNYVSWYRQDPGRAPKLILFEVSNRPSGISNRFSASKSGSTASLTISGLQADDESDYYCSSCTTAPVCVFGNGTRVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 176 - protein, 216 aa, Artificial Sequence
  Synthetically generated peptide
AQDIQMTQSPSSLSASVGDRVTITCRASQGISNYLAWYQQKPGKVPKLLIYAASTLQSGVPSRFSGSGSGTDFTLTISSLQPEDFATYYCQQSYSTPYTFGQGTKLEVRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 177 - protein, 10 aa, Artificial Sequence
  Synthetically generated peptide
SSYTSSYTWV

SEQ ID NO: 178 - protein, 5 aa, Artificial Sequence
  Synthetically generated peptide
HYHMQ

SEQ ID NO: 179 - protein, 448 aa, Artificial Sequence
  Synthetically generated peptide
EVQLLESGGGLVQPGGSLRLSCAASGFTFSRYTMEWVRQAPGKGLEWVSVIRPSGGTTMYADSVKGRFTISRDNSKNTLYLQMNSLRAEDMAVYYCARVGVWYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 17 aa, Artificial Sequence
  Synthetically generated peptide
EVTMVRGVYYYYYGMDV

SEQ ID NO: 181 - protein, 13 aa, Artificial Sequence
  Synthetically generated peptide
SGSSSNIGSNYVY

SEQ ID NO: 182 - protein, 235 aa, Artificial Sequence
  Synthetically generated peptide
EVQLLESGGGLVQPGGSLRLSCAASGFTFSQYLMAWVRQAPGKGLEWVSSIYPSGGNTNYADSVKGRFTISRDNSKNTLYLQMNSLRAEDTAVYYCARDRSIVPYSSSWYMPRDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 183 - protein, 12 aa, Artificial Sequence
  Synthetically generated peptide
AAWDDSLSGHAV

SEQ ID NO: 184 - protein, 5 aa, Artificial Sequence
  Synthetically generated peptide
HYQMH

SEQ ID NO: 185 - protein, 17 aa, Artificial Sequence
  Synthetically generated peptide
RIRSSGGATSYADSVKG

SEQ ID NO: 186 - protein, 10 aa, Artificial Sequence
  Synthetically generated peptide
GGGYSYYFDY

SEQ ID NO: 187 - protein, 15 aa, Artificial Sequence
  Synthetically generated peptide
TGTSTDDVGGYNYVS

SEQ ID NO: 188 - protein, 7 aa, Artificial Sequence
  Synthetically generated peptide
DVINRPS

SEQ ID NO: 189 - protein, 10 aa, Artificial Sequence
  Synthetically generated peptide
SSYTSRGTRV

SEQ ID NO: 190 - protein, 5 aa, Artificial Sequence
  Synthetically generated peptide
DYRMW

SEQ ID NO: 191 - protein, 17 aa, Artificial Sequence
  Synthetically generated peptide
YIVPSGGQTSYADSVKG

SEQ ID NO: 192 - protein, 28 aa, Artificial Sequence
  Synthetically generated peptide
GSAYQRRTYSSGWYSASGRRGTAEYFQH

SEQ ID NO: 193 - protein, 11 aa, Artificial Sequence
  Synthetically generated peptide
RASQSISNWLA

SEQ ID NO: 194 - protein, 7 aa, Artificial Sequence
  Synthetically generated peptide
MASTLES

SEQ ID NO: 195 - protein, 9 aa, Artificial Sequence
  Synthetically generated peptide
QQYNSYSVT

SEQ ID NO: 196 - protein, 5 aa, Artificial Sequence
  Synthetically generated peptide
HYLMY

SEQ ID NO: 197 - protein, 17 aa, Artificial Sequence
  Synthetically generated peptide
WIGPSGGHTMYADSVKG

SEQ ID NO: 198 - protein, 7 aa, Artificial Sequence
  Synthetically generated peptide
LQQGLDY

SEQ ID NO: 199 - protein, 12 aa, Artificial Sequence
  Synthetically generated peptide
RASQSVSSNYLA

SEQ ID NO: 200 - protein, 8 aa, Artificial Sequence
  Synthetically generated peptide
YGASYRAT

SEQ ID NO: 201 - protein, 9 aa, Artificial Sequence
  Synthetically generated peptide
QQSYSTPWT

SEQ ID NO: 202 - protein, 5 aa, Artificial Sequence
  Synthetically generated peptide
HYLMY

SEQ ID NO: 203 - protein, 17 aa, Artificial Sequence
  Synthetically generated peptide
RIYPSGGATSYADSVKG

SEQ ID NO: 204 - protein, 9 aa, Artificial Sequence
  Synthetically generated peptide
SGSWYSFDY

SEQ ID NO: 205 - protein, 11 aa, Artificial Sequence
  Synthetically generated peptide
RASQGIGNYLV

SEQ ID NO: 206 - protein, 7 aa, Artificial Sequence
  Synthetically generated peptide
AASTLQS

SEQ ID NO: 207 - protein, 9 aa, Artificial Sequence
  Synthetically generated peptide
QKYDGAPFT

SEQ ID NO: 208 - protein, 5 aa, Artificial Sequence
  Synthetically generated peptide
PYYMQ

SEQ ID NO: 209 - protein, 17 aa, Artificial Sequence
  Synthetically generated peptide
GISSSGGSTQYADSVKG

SEQ ID NO: 210 - protein, 16 aa, Artificial Sequence
  Synthetically generated peptide
SQRRTYYPNFGDAFDI

SEQ ID NO: 211 - protein, 11 aa, Artificial Sequence
  Synthetically generated peptide
RASQSISSWLA

SEQ ID NO: 212 - protein, 7 aa, Artificial Sequence
  Synthetically generated peptide
KASSLES

SEQ ID NO: 213 - protein, 9 aa, Artificial Sequence
  Synthetically generated peptide
QQYNSYRYT

SEQ ID NO: 214 - protein, 5 aa, Artificial Sequence
  Synthetically generated peptide
HYWMM

SEQ ID NO: 215 - protein, 17 aa, Artificial Sequence
  Synthetically generated peptide
WIGSSGGFTWYADSVKG

SEQ ID NO: 216 - protein, 7 aa, Artificial Sequence
  Synthetically generated peptide
GNGGFDS

SEQ ID NO: 217 - protein, 13 aa, Artificial Sequence
  Synthetically generated peptide
SGTLSNIGTNIVS

SEQ ID NO: 218 - protein, 7 aa, Artificial Sequence
  Synthetically generated peptide
NDHRRPS

SEQ ID NO: 219 - protein, 11 aa, Artificial Sequence
  Synthetically generated peptide
AAWDDSLNGVV

SEQ ID NO: 220 - protein, 5 aa, Artificial Sequence
  Synthetically generated peptide
MYKMG

SEQ ID NO: 221 - protein, 17 aa, Artificial Sequence
  Synthetically generated peptide
SIVPSGGKTQYADSVKG

SEQ ID NO: 222 - protein, 145 aa, Artificial Sequence
  Synthetically generated peptide
EVQLLESGGGLVQPGGSLRLSCAASGFTFSRYYMEWVRQAPGKGLEWVSSISSSGGSTEYADSVKGRFTISRDNSKNTLYLQMNSLRAEDTAVYYCAKDITPGGGSGFRLPKNYYYYGMDVWGQGTTVTVSSASTKGPSVFPLAP

SEQ ID NO: 223 - protein, 16 aa, Artificial Sequence
  Synthetically generated peptide
RSSQSLVYSDGNTYLN

SEQ ID NO: 224 - protein, 7 aa, Artificial Sequence
  Synthetically generated peptide
KVSNRDS

SEQ ID NO: 225 - protein, 10 aa, Artificial Sequence
  Synthetically generated peptide
MQGTHWQRLT

SEQ ID NO: 226 - protein, 5 aa, Artificial Sequence
  Synthetically generated peptide
WYFMV

SEQ ID NO: 227 - protein, 17 aa, Artificial Sequence
  Synthetically generated peptide
GIGPSGGLTTYADSVKG

SEQ ID NO: 228 - protein, 6 aa, Artificial Sequence
  Synthetically generated peptide
SDWLNY

SEQ ID NO: 229 - protein, 14 aa, Artificial Sequence
  Synthetically generated peptide
TGGRRDIGNYNYVS

SEQ ID NO: 230 - protein, 7 aa, Artificial Sequence
  Synthetically generated peptide
DVRKRPS

SEQ ID NO: 231 - protein, 9 aa, Artificial Sequence
  Synthetically generated peptide
GSYTGTSNV

SEQ ID NO: 232 - protein, 11 aa, Artificial Sequence
  Synthetically generated peptide
  VARIANT 2: Xaa = Arg or Val
  VARIANT 4: Xaa = any amino acid
  VARIANT 5: Xaa = Trp or Tyr
  VARIANT 6: Xaa = Tyr or Gly
  VARIANT 7: Xaa = Ala, Gly or Ser
  VARIANT (8)...(0): Xaa = Phe or Met
  VARIANT (10)...(0): Xaa = Tyr, ile or Val
RXGXXXXXDXW

SEQ ID NO: 233 - protein, 17 aa, Artificial Sequence
  Synthetically generated peptide
RIYPSGGQTYYADSVKG

SEQ ID NO: 234 - protein, 7 aa, Artificial Sequence
  Synthetically generated peptide
GAGWFDP

SEQ ID NO: 235 - protein, 12 aa, Artificial Sequence
  Synthetically generated peptide
RASQSVGSDYLA

SEQ ID NO: 236 - protein, 7 aa, Artificial Sequence
  Synthetically generated peptide
AASTRAT

SEQ ID NO: 237 - protein, 7 aa, Artificial Sequence
  Synthetically generated peptide
QQYDPRT

SEQ ID NO: 238 - protein, 5 aa, Artificial Sequence
  Synthetically generated peptide
WYAMH

SEQ ID NO: 239 - protein, 17 aa, Artificial Sequence
  Synthetically generated peptide
WISPSGGQTKYADSVKG

SEQ ID NO: 240 - protein, 18 aa, Artificial Sequence
  Synthetically generated peptide
AKVLRYFDWLLGGDAFDI

SEQ ID NO: 241 - protein, 11 aa, Artificial Sequence
  Synthetically generated peptide
RASQSVSFNLA

SEQ ID NO: 242 - protein, 8 aa, Artificial Sequence
  Synthetically generated peptide
  VARIANT 2: Xaa = Tyr or Pro
  VARIANT 4: Xaa = Tyr or Gly
  VARIANT 5: Xaa = Ala or Gly
  VARIANT 6: Xaa = Met or Phe
  VARIANT 8: Xaa = Val or Ile
YXYXXXDX

SEQ ID NO: 243 - protein, 9 aa, Artificial Sequence
  Synthetically generated peptide
QQYGTSPFT

SEQ ID NO: 244 - protein, 5 aa, Artificial Sequence
  Synthetically generated peptide
PYFME

SEQ ID NO: 245 - protein, 17 aa, Artificial Sequence
  Synthetically generated peptide
GISSSGGNTLYADSVKG

SEQ ID NO: 246 - protein, 20 aa, Artificial Sequence
  Synthetically generated peptide
DRFGNYYGSGSKLQHDAFDI

SEQ ID NO: 247 - protein, 11 aa, Artificial Sequence
  Synthetically generated peptide
RASQTIRTYLN

SEQ ID NO: 248 - protein, 5 aa, Artificial Sequence
  Synthetically generated peptide
DNLQT

SEQ ID NO: 249 - protein, 9 aa, Artificial Sequence
  Synthetically generated peptide
QQSYGGPPT

SEQ ID NO: 250 - protein, 5 aa, Artificial Sequence
  Synthetically generated peptide
FYSMS

SEQ ID NO: 251 - protein, 17 aa, Artificial Sequence
  Synthetically generated peptide
RIRPSGGRTDYADSVKG

SEQ ID NO: 252 - protein, 18 aa, Artificial Sequence
  Synthetically generated peptide
DRLYYYGSGSYYYGAFDI

SEQ ID NO: 253 - protein, 11 aa, Artificial Sequence
  Synthetically generated peptide
RASQSISTYLN

SEQ ID NO: 254 - protein, 11 aa, Artificial Sequence
  Synthetically generated peptide
  VARIANT 1: Xaa = Arg or Gly
  VARIANT 4: Xaa = Gln or Ser
  VARIANT 6: Xaa = Ile or Val
  VARIANT 7, 8: Xaa = Ser or Gly
  VARIANT 10: Xaa = Leu or Tyr
  VARIANT (11)...(0): Xaa = Asn or Ala
XASXSXXXYXX

SEQ ID NO: 255 - protein, 9 aa, Artificial Sequence
  Synthetically generated peptide
QQYNSFPFS

SEQ ID NO: 256 - protein, 5 aa, Artificial Sequence
  Synthetically generated peptide
HYLMD

SEQ ID NO: 257 - protein, 17 aa, Artificial Sequence
  Synthetically generated peptide
VIYPSGGHTNYADSVKG

SEQ ID NO: 258 - protein, 11 aa, Artificial Sequence
  Synthetically generated peptide
  VARIANT 1: Xaa = Arg, Gly or Val
  VARIANT 4: Xaa = Gln or Ser
  VARIANT 6: Xaa = Ile or Val
  VARIANT 7: Xaa = Ser or Gly
  VARIANT 8: Xaa = Ser or Thr
  VARIANT (9)...(0): Xaa = Tyr or Asn
  VARIANT (11)...(0): Xaa = Asn or Ala
XASXSXXXXLX

SEQ ID NO: 259 - protein, 12 aa, Artificial Sequence
  Synthetically generated peptide
RASQSVSSSYLA

SEQ ID NO: 260 - protein, 10 aa, Artificial Sequence
  Synthetically generated peptide
  VARIANT 5, 9: Xaa = any amino acid
  VARIANT 7: Xaa = Ser or Gly
  VARIANT 8: Xaa = Ser, Leu or Gly
  VARIANT 10: Xaa = Leu or Tyr
RASQXIXXXX

SEQ ID NO: 261 - protein, 5 aa, Artificial Sequence
  Synthetically generated peptide
QQWDT

SEQ ID NO: 262 - protein, 5 aa, Artificial Sequence
  Synthetically generated peptide
HYKMG

SEQ ID NO: 263 - protein, 17 aa, Artificial Sequence
  Synthetically generated peptide
SIRPSGGATKYADSVKG

SEQ ID NO: 264 - protein, 9 aa, Artificial Sequence
  Synthetically generated peptide
VGIWDAFDI

SEQ ID NO: 265 - protein, 11 aa, Artificial Sequence
  Synthetically generated peptide
  VARIANT 3: Xaa = Ala or Gly
  VARIANT 4: Xaa = Ala or Val
  VARIANT 6: Xaa = Asn or Ser
  VARIANT 7: Xaa = Arg or Leu
  VARIANT 8: Xaa = Pro or Ala
  VARIANT (11)...(0): Xaa = Val or Ile
IYXXSXXXSGX

SEQ ID NO: 266 - protein, 11 aa, Artificial Sequence
  Synthetically generated peptide
  VARIANT 3: Xaa = Ala or Gly
  VARIANT 4: Xaa = Ala or Val
  VARIANT 7: Xaa = Arg or Leu
  VARIANT 8: Xaa = Pro, Ala or Gln
  VARIANT 9: Xaa = Ser or Thr
  VARIANT (11)...(0): Xaa = Val or Ile
IYXXSSXXXGX

SEQ ID NO: 267 - protein, 9 aa, Artificial Sequence
  Synthetically generated peptide
QQTYSTLFT

SEQ ID NO: 268 - protein, 5 aa, Artificial Sequence
  Synthetically generated peptide
HYKME

SEQ ID NO: 269 - protein, 17 aa, Artificial Sequence
  Synthetically generated peptide
RIRPSGGVTKYADSVKG

SEQ ID NO: 270 - protein, 9 aa, Artificial Sequence
  Synthetically generated peptide
GGLWDAFDI

SEQ ID NO: 271 - protein, 13 aa, Artificial Sequence
  Synthetically generated peptide
SGSSSNIGSNIVS

SEQ ID NO: 272 - protein, 7 aa, Artificial Sequence
  Synthetically generated peptide
SNNRRPS

SEQ ID NO: 273 - protein, 11 aa, Artificial Sequence
  Synthetically generated peptide
AAWDDSLNGHV

SEQ ID NO: 274 - protein, 5 aa, Artificial Sequence
  Synthetically generated peptide
WYTMT

SEQ ID NO: 275 - protein, 17 aa, Artificial Sequence
  Synthetically generated peptide
SIYPSGGHTSYADSVKG

SEQ ID NO: 276 - protein, 15 aa, Artificial Sequence
  Synthetically generated peptide
DTRVGPWLVRAPLDY

SEQ ID NO: 277 - protein, 14 aa, Artificial Sequence
  Synthetically generated peptide
TGTSTDVGGYNYVS

SEQ ID NO: 278 - protein, 10 aa, Artificial Sequence
  Synthetically generated peptide
  VARIANT 3: Xaa = Tyr or Ser
  VARIANT 4: Xaa = Thr, Ala, Asn, Gly or Tyr
  VARIANT 6: Xaa = Ser, Pro or Thr
  VARIANT 7: Xaa = Pro or Ser
  VARIANT 8: Xaa = any amino acid
QQXXSXXXTF

SEQ ID NO: 279 - protein, 10 aa, Artificial Sequence
  Synthetically generated peptide
SSYTNTITVV

SEQ ID NO: 280 - protein, 5 aa, Artificial Sequence
  Synthetically generated peptide
HYLMY

SEQ ID NO: 281 - protein, 17 aa, Artificial Sequence
  Synthetically generated peptide
RIGPSGGWTKYADSVKG

SEQ ID NO: 282 - protein, 11 aa, Artificial Sequence
  Synthetically generated peptide
  VARIANT 1: Xaa = Cys or Ala
  VARIANT 3: Xaa = Gln or Trp
  VARIANT 4: Xaa = Tyr or Asp
  VARIANT 9: Xaa = any amino acid
XQXXDSLPXTF

SEQ ID NO: 283 - protein, 12 aa, Artificial Sequence
  Synthetically generated peptide
RASQSVSSSYLA

SEQ ID NO: 284 - protein, 12 aa, Artificial Sequence
  Synthetically generated peptide
  VARIANT 6: Xaa = Ile or Val
  VARIANT 9: Xaa = Tyr or Ser
  VARIANT 10: Xaa = Leu or Tyr
  VARIANT 11: Xaa = Gln or Ala
  VARIANT 12: Ala or absent
RASQSXSSXXXX

SEQ ID NO: 285 - protein, 9 aa, Artificial Sequence
  Synthetically generated peptide
QQYGSSPFT

SEQ ID NO: 286 - protein, 5 aa, Artificial Sequence
  Synthetically generated peptide
HYLMH

SEQ ID NO: 287 - protein, 17 aa, Artificial Sequence
  Synthetically generated peptide
VIYPSGGTTKYADSVKG

SEQ ID NO: 288 - protein, 8 aa, Artificial Sequence
  Synthetically generated peptide
GNSGSHDY

SEQ ID NO: 289 - protein, 11 aa, Artificial Sequence
  Synthetically generated peptide
RASQGIGNYLA

SEQ ID NO: 290 - protein, 7 aa, Artificial Sequence
  Synthetically generated peptide
KTSNLQS

SEQ ID NO: 291 - protein, 10 aa, Artificial Sequence
  Synthetically generated peptide
QRYDSYSQYI

SEQ ID NO: 292 - protein, 5 aa, Artificial Sequence
  Synthetically generated peptide
MYVMN

SEQ ID NO: 293 - protein, 17 aa, Artificial Sequence
  Synthetically generated peptide
RIGSSGGGTLYADSVKG

SEQ ID NO: 294 - protein, 16 aa, Artificial Sequence
  Synthetically generated peptide
VSVYRIRNYYYYAMDV

SEQ ID NO: 295 - protein, 11 aa, Artificial Sequence
  Synthetically generated peptide
RASQSVSGFLA

SEQ ID NO: 296 - protein, 11 aa, Artificial Sequence
  Synthetically generated peptide
  VARIANT 1: Xaa = Cys or Ala
  VARIANT 3: Xaa = Gln or Trp
  VARIANT 4: Xaa = Tyr or Asp
XQXXDSLPGTF

SEQ ID NO: 297 - protein, 10 aa, Artificial Sequence
  Synthetically generated peptide
QQYGDSSPIT

SEQ ID NO: 298 - protein, 5 aa, Artificial Sequence
  Synthetically generated peptide
MYGMT

SEQ ID NO: 299 - protein, 17 aa, Artificial Sequence
  Synthetically generated peptide
GISPSGGRTYYADSVKG

SEQ ID NO: 300 - protein, 14 aa, Artificial Sequence
  Synthetically generated peptide
HRRDYVWWTYGMDV

SEQ ID NO: 301 - protein, 8 aa, Artificial Sequence
  Synthetically generated peptide
AKASILET

SEQ ID NO: 302 - protein, 9 aa, Artificial Sequence
  Synthetically generated peptide
QQYASPSYT

SEQ ID NO: 303 - protein, 10 aa, Artificial Sequence
  Synthetically generated peptide
QQANSFPSLT

SEQ ID NO: 304 - protein, 5 aa, Artificial Sequence
  Synthetically generated peptide
NYSMQ

SEQ ID NO: 305 - protein, 17 aa, Artificial Sequence
  Synthetically generated peptide
GIRPSGGSTRYADSVKG

SEQ ID NO: 306 - protein, 11 aa, Artificial Sequence
  Synthetically generated peptide
STGGYYYGMDV

SEQ ID NO: 307 - protein, 5 aa, Artificial Sequence
  Synthetically generated peptide
KYVMW

SEQ ID NO: 308 - protein, 17 aa, Artificial Sequence
  Synthetically generated peptide
SIVSSGGRTSYADSVKG

SEQ ID NO: 309 - protein, 10 aa, Artificial Sequence
  Synthetically generated peptide
QQRSNWPPYT

SEQ ID NO: 310 - protein, 5 aa, Artificial Sequence
  Synthetically generated peptide
PYMMG

SEQ ID NO: 311 - protein, 17 aa, Artificial Sequence
  Synthetically generated peptide
SIRSSGGATAYADSVKG

SEQ ID NO: 312 - protein, 21 aa, Artificial Sequence
  Synthetically generated peptide
AYDYVWGSYRYKGRPVGAFDI

SEQ ID NO: 313 - protein, 11 aa, Artificial Sequence
  Synthetically generated peptide
RASQAISTNLN

SEQ ID NO: 314 - protein, 6 aa, Artificial Sequence
  Synthetically generated peptide
  VARIANT 1: Xaa = Ala, Asp or Gly
  VARIANT 4: Xaa = Ser or Asn
  VARIANT 5: Xaa = Leu or Arg
  VARIANT 6: Xaa = Gln or Ala, and  Ser or Thr
XASXXX

SEQ ID NO: 315 - protein, 9 aa, Artificial Sequence
  Synthetically generated peptide
QQTFSPPHT

SEQ ID NO: 316 - protein, 5 aa, Artificial Sequence
  Synthetically generated peptide
RYYME

SEQ ID NO: 317 - protein, 17 aa, Artificial Sequence
  Synthetically generated peptide
SISSSGGSTEYADSVKG

SEQ ID NO: 318 - protein, 11 aa, Artificial Sequence
  Synthetically generated peptide
RASQPISTSLA

SEQ ID NO: 319 - protein, 12 aa, Artificial Sequence
  Synthetically generated peptide
GASQSVSSSYLA

SEQ ID NO: 320 - protein, 7 aa, Artificial Sequence
  Synthetically generated peptide
DASSRAT

SEQ ID NO: 321 - protein, 9 aa, Artificial Sequence
  Synthetically generated peptide
LHDYNFPFT

SEQ ID NO: 322 - protein, 5 aa, Artificial Sequence
  Synthetically generated peptide
HYPMI

SEQ ID NO: 323 - protein, 17 aa, Artificial Sequence
  Synthetically generated peptide
GIYSSGGTTKYADSVKG

SEQ ID NO: 324 - protein, 131 aa, Artificial Sequence
  Synthetically generated peptide
EVQLLESGGGLVQPGGSLRLSCAASGFTFSWYWMYWVRQAPGKGLEWVSVIGSSGGVTKYADSVKGRFTISRDNSKNTLYLQMNSLRAEDTATYYCARGPYRGYFDYWGQGTLVTVSSASTKGPSVFPLAP

SEQ ID NO: 325 - protein, 11 aa, Artificial Sequence
  Synthetically generated peptide
RASQAISNYLA

SEQ ID NO: 326 - protein, 7 aa, Artificial Sequence
  Synthetically generated peptide
AASTLQS

SEQ ID NO: 327 - protein, 9 aa, Artificial Sequence
  Synthetically generated peptide
QTYYSVPFT

SEQ ID NO: 328 - protein, 5 aa, Artificial Sequence
  Synthetically generated peptide
IYAMI

SEQ ID NO: 329 - protein, 17 aa, Artificial Sequence
  Synthetically generated peptide
SIYSSGGPTQYADSVKG

SEQ ID NO: 330 - protein, 20 aa, Artificial Sequence
  Synthetically generated peptide
GRRTYYYDSSGYYKYAAFDI

SEQ ID NO: 331 - protein, 14 aa, Artificial Sequence
  Synthetically generated peptide
TGTSSDVGGYNYLS

SEQ ID NO: 332 - protein, 7 aa, Artificial Sequence
  Synthetically generated peptide
GVSNRPS

SEQ ID NO: 333 - protein, 10 aa, Artificial Sequence
  Synthetically generated peptide
SSYTSTGTRV

SEQ ID NO: 334 - protein, 5 aa, Artificial Sequence
  Synthetically generated peptide
NYTMT

SEQ ID NO: 335 - protein, 17 aa, Artificial Sequence
  Synthetically generated peptide
VIYPSGGHTTYADSVKG

SEQ ID NO: 336 - protein, 131 aa, Artificial Sequence
  Synthetically generated peptide
EVQLLESGGGLVQPGGSLRLSCAASGFTFSHYLMYWVRQAPGKGLEWVSRIYPSGGATSYADSVKGRFTISRDNSKNTLYLQMNSLRAEDTAVYYCAKSGSWYSFDYWGQGTLVTVSSASTKGPSVFPLAP

SEQ ID NO: 337 - protein, 14 aa, Artificial Sequence
  Synthetically generated peptide
TGGRRDIGNYNYVS

SEQ ID NO: 338 - protein, 7 aa, Artificial Sequence
  Synthetically generated peptide
DVRKRPS

SEQ ID NO: 339 - protein, 9 aa, Artificial Sequence
  Synthetically generated peptide
GSYTGTSNV

SEQ ID NO: 340 - protein, 131 aa, Artificial Sequence
  Synthetically generated peptide
EVQLLESGGGLVQPGGSLRLSCAASGFTFSKYYMVWVRQAPGKGLEWVSVIGPSGGWTTYADSVKGRFTISRDNSKNTLYLQMNSLRAEDTAVYYCARVDYSNYFDYWGQGTLVTVSSASTKGPSVFPLAP

SEQ ID NO: 341 - protein, 17 aa, Artificial Sequence
  Synthetically generated peptide
SIYPSGGSTRYADSVKG

SEQ ID NO: 342 - protein, 7 aa, Artificial Sequence
  Synthetically generated peptide
FNVGFDL

SEQ ID NO: 343 - protein, 127 aa, Artificial Sequence
  Synthetically generated peptide
EVQLLESGGGLVQPGGSLRLSCAASGFTFSHYPMHWVRQAPGKGLEWVSSIWPSGGHTSYADSVKGRFTISRDNSKNTLYLQMNSLRAEDTATYYCARLSQPIWGQGTLVTVSSASTKGPSVFPLAP

SEQ ID NO: 344 - protein, 130 aa, Artificial Sequence
  Synthetically generated peptide
EVQLLESGGGLVQPGGSLRLSCAASGFTFSHYIMHWVRQAPGKGLEWVSGIYPSGGSTKYADSVKGRFTISRDNSKNTLYLQMNSLRAEDTAVYYCARALVGALDYWGQGTLVTVSSASTKGPSVFPLAP

SEQ ID NO: 345 - protein, 9 aa, Artificial Sequence
  Synthetically generated peptide
QQSYSTLYT

SEQ ID NO: 346 - protein, 5 aa, Artificial Sequence
  Synthetically generated peptide
WYRMS

SEQ ID NO: 347 - protein, 17 aa, Artificial Sequence
  Synthetically generated peptide
SISPSGGPTKYADSVKG

SEQ ID NO: 348 - protein, 13 aa, Artificial Sequence
  Synthetically generated peptide
PSGDSSVYRPFAS

SEQ ID NO: 349 - protein, 14 aa, Artificial Sequence
  Synthetically generated peptide
TDTSGNVGSYNLVS

SEQ ID NO: 350 - protein, 7 aa, Artificial Sequence
  Synthetically generated peptide
EVSRRPS

SEQ ID NO: 351 - protein, 10 aa, Artificial Sequence
  Synthetically generated peptide
CSYAGSNTYV

SEQ ID NO: 352 - protein, 5 aa, Artificial Sequence
  Synthetically generated peptide
NYSMV

SEQ ID NO: 353 - protein, 17 aa, Artificial Sequence
  Synthetically generated peptide
RIYSSGGSTHYADSVKG

SEQ ID NO: 354 - protein, 132 aa, Artificial Sequence
  Synthetically generated peptide
EVQLLESGGGLVQPGGSLRLSCAASGFTFSWYAMHWVRQAPGKGLEWVSVISPSGGATRYADSVKGRFTISRDNSKNTLYLQMNSLRAEDTAVYYCVRASTVTTLFQHWGQGTLVTVSSASTKGPSVFPLAP

SEQ ID NO: 355 - protein, 13 aa, Artificial Sequence
  Synthetically generated peptide
SGGSSNIGSNRVN

SEQ ID NO: 356 - protein, 7 aa, Artificial Sequence
  Synthetically generated peptide
SNNQRPS

SEQ ID NO: 357 - protein, 11 aa, Artificial Sequence
  Synthetically generated peptide
AAWDDNLIGPV

SEQ ID NO: 358 - protein, 5 aa, Artificial Sequence
  Synthetically generated peptide
WYHMY

SEQ ID NO: 359 - protein, 17 aa, Artificial Sequence
  Synthetically generated peptide
YIRPSGGNTNYADSVKG

SEQ ID NO: 360 - protein, 18 aa, Artificial Sequence
  Synthetically generated peptide
DRRGYSSSKGYYYYGMDV

SEQ ID NO: 361 - protein, 13 aa, Artificial Sequence
  Synthetically generated peptide
SGSSSNIGSNYVY

SEQ ID NO: 362 - protein, 142 aa, Artificial Sequence
  Synthetically generated peptide
EVQLLESGGGLVQPGGSLRLSCAASGFTFSRYAMAWVRQAPGKGLEWVSSIGSSGGVTKYADSVKGRFTISRDNSKNTLYLQMNSLRAEDTAVYYCAAPRGRYYYDSSGYYYGGVFDYWGQGTLVTVSSASTKGPSVFPLAP

SEQ ID NO: 363 - protein, 11 aa, Artificial Sequence
  Synthetically generated peptide
AAWDDSMSGVV

SEQ ID NO: 364 - protein, 5 aa, Artificial Sequence
  Synthetically generated peptide
HYFMH

SEQ ID NO: 365 - protein, 17 aa, Artificial Sequence
  Synthetically generated peptide
YISSSGGLTGYADSVKG

SEQ ID NO: 366 - protein, 131 aa, Artificial Sequence
  Synthetically generated peptide
EVQLLESGGGLVQPGGSLRLSCAASGFTFSHYRMDWVRQAPGKGLEWVSGIYPSGGHTNYADSVKGRFTISRDNSKNTLYLQMNSLRAEDTAVYYCARDRGWYGADYWGQGTLVTVSSASTKGPSVFPLAP

SEQ ID NO: 367 - protein, 14 aa, Artificial Sequence
  Synthetically generated peptide
TGSTSDVGGYTYVS

SEQ ID NO: 368 - protein, 7 aa, Artificial Sequence
  Synthetically generated peptide
DVSKRPS

SEQ ID NO: 369 - protein, 10 aa, Artificial Sequence
  Synthetically generated peptide
CSYAGSYSYV

SEQ ID NO: 370 - protein, 5 aa, Artificial Sequence
  Synthetically generated peptide
NYHMD

SEQ ID NO: 371 - protein, 17 aa, Artificial Sequence
  Synthetically generated peptide
VIGPSGGFTRYADSVKG

SEQ ID NO: 372 - protein, 8 aa, Artificial Sequence
  Synthetically generated peptide
ALGGSLDY

SEQ ID NO: 373 - protein, 14 aa, Artificial Sequence
  Synthetically generated peptide
TATSSDLGSYNFVS

SEQ ID NO: 374 - protein, 7 aa, Artificial Sequence
  Synthetically generated peptide
EVSRRPS

SEQ ID NO: 375 - protein, 10 aa, Artificial Sequence
  Synthetically generated peptide
CSYAGSNTYV

SEQ ID NO: 376 - protein, 5 aa, Artificial Sequence
  Synthetically generated peptide
NYSMM

SEQ ID NO: 377 - protein, 17 aa, Artificial Sequence
  Synthetically generated peptide
SIYPSGGFTKYADSVKG

SEQ ID NO: 378 - protein, 8 aa, Artificial Sequence
  Synthetically generated peptide
VGFYGGFV

SEQ ID NO: 379 - protein, 11 aa, Artificial Sequence
  Synthetically generated peptide
RASQSISSWLA

SEQ ID NO: 380 - protein, 7 aa, Artificial Sequence
  Synthetically generated peptide
KASSLGS

SEQ ID NO: 381 - protein, 9 aa, Artificial Sequence
  Synthetically generated peptide
QQYYSYSQT

SEQ ID NO: 382 - protein, 5 aa, Artificial Sequence
  Synthetically generated peptide
NYPMH

SEQ ID NO: 383 - protein, 17 aa, Artificial Sequence
  Synthetically generated peptide
YIGPSGGWTRYADSVKG

SEQ ID NO: 384 - protein, 5 aa, Artificial Sequence
  Synthetically generated peptide
APSGY

SEQ ID NO: 385 - protein, 12 aa, Artificial Sequence
  Synthetically generated peptide
TGTSSDVGNFVS

SEQ ID NO: 386 - protein, 7 aa, Artificial Sequence
  Synthetically generated peptide
DVSRRPS

SEQ ID NO: 387 - protein, 10 aa, Artificial Sequence
  Synthetically generated peptide
SSYAGSNNYV

SEQ ID NO: 388 - protein, 5 aa, Artificial Sequence
  Synthetically generated peptide
PYRMS

SEQ ID NO: 389 - protein, 17 aa, Artificial Sequence
  Synthetically generated peptide
VISPSGGITEYADSVKG

SEQ ID NO: 390 - protein, 18 aa, Artificial Sequence
  Synthetically generated peptide
HERGSGYYVTPPAGAFDI

SEQ ID NO: 391 - protein, 11 aa, Artificial Sequence
  Synthetically generated peptide
RASQSIANYLN

SEQ ID NO: 392 - protein, 7 aa, Artificial Sequence
  Synthetically generated peptide
AASRLHS

SEQ ID NO: 393 - protein, 7 aa, Artificial Sequence
  Synthetically generated peptide
QQSHDLT

SEQ ID NO: 394 - protein, 5 aa, Artificial Sequence
  Synthetically generated peptide
HYAMG

SEQ ID NO: 395 - protein, 17 aa, Artificial Sequence
  Synthetically generated peptide
RIWPSGGHTQYADSVKG

SEQ ID NO: 396 - protein, 11 aa, Artificial Sequence
  Synthetically generated peptide
GYSSTWGAFDI

SEQ ID NO: 397 - protein, 14 aa, Artificial Sequence
  Synthetically generated peptide
TGTSSDVGGYNYVS

SEQ ID NO: 398 - protein, 131 aa, Artificial Sequence
  Synthetically generated peptide
EVQLLESGGGLVQPGGSLRLSCAASGFTFSNYPMYWVRQAPGKGLEWVSRIGPSGGHTDYADSVKGRFTISRDNSKNTLYLQMNSLRAEDTAVYYCARAGVWSGLDYWGQGTLVTVSSASTKGPSVFPLAP

SEQ ID NO: 399 - protein, 10 aa, Artificial Sequence
  Synthetically generated peptide
SSYKRGGTYV

SEQ ID NO: 400 - protein, 5 aa, Artificial Sequence
  Synthetically generated peptide
WYGMG

SEQ ID NO: 401 - protein, 17 aa, Artificial Sequence
  Synthetically generated peptide
VIRPSGGTTRYADSVKG

SEQ ID NO: 402 - protein, 9 aa, Artificial Sequence
  Synthetically generated peptide
GGRYYSLDY

SEQ ID NO: 403 - protein, 11 aa, Artificial Sequence
  Synthetically generated peptide
RASQSVTTFLA

SEQ ID NO: 404 - protein, 7 aa, Artificial Sequence
  Synthetically generated peptide
GASSRAA

SEQ ID NO: 405 - protein, 9 aa, Artificial Sequence
  Synthetically generated peptide
QQYRFSPPT

SEQ ID NO: 406 - protein, 5 aa, Artificial Sequence
  Synthetically generated peptide
PYNMA

SEQ ID NO: 407 - protein, 17 aa, Artificial Sequence
  Synthetically generated peptide
SIWPSGGRTRYADSVKG

SEQ ID NO: 408 - protein, 19 aa, Artificial Sequence
  Synthetically generated peptide
GVRSSGLLERGRVYDAFDI

SEQ ID NO: 409 - protein, 12 aa, Artificial Sequence
  Synthetically generated peptide
RASQSVSGSYLA

SEQ ID NO: 410 - protein, 7 aa, Artificial Sequence
  Synthetically generated peptide
GAYSRAT

SEQ ID NO: 411 - protein, 9 aa, Artificial Sequence
  Synthetically generated peptide
QHYGSSPRT

SEQ ID NO: 412 - protein, 5 aa, Artificial Sequence
  Synthetically generated peptide
HYQMH

SEQ ID NO: 413 - protein, 17 aa, Artificial Sequence
  Synthetically generated peptide
SIRPSGGRTAYADSVKG

SEQ ID NO: 414 - protein, 131 aa, Artificial Sequence
  Synthetically generated peptide
EVQLLESGGGLVQPGGSLRLSCAASGFTFSWYLMGWVRQAPGKGLEWVSVIGPSGGLTKYADSVKGRFTISRDNSKNTLYLQMNSLRAEDTAVYYCARFRGYYGMDVWGQGTTVTVSSASTKGPSVFPLAP

SEQ ID NO: 415 - protein, 11 aa, Artificial Sequence
  Synthetically generated peptide
RAGQNIYYWLA

SEQ ID NO: 416 - protein, 131 aa, Artificial Sequence
  Synthetically generated peptide
EVQLLESGGGLVQPGGSLRLSCAASGFTFSWYTMQWVRQAPGKGLEWVSRIYSSGGGTYYADSVKGRFTISRDNSKNTLYLQMNSLRAEDTAMYYCARVGPWGAFDIWGQGTMVTVSSASTKGPSVFPLAP

SEQ ID NO: 417 - protein, 9 aa, Artificial Sequence
  Synthetically generated peptide
QQAKSFPVT

SEQ ID NO: 418 - protein, 5 aa, Artificial Sequence
  Synthetically generated peptide
PYIMS

SEQ ID NO: 419 - protein, 17 aa, Artificial Sequence
  Synthetically generated peptide
SIVSSGGVTLYADSVKG

SEQ ID NO: 420 - protein, 131 aa, Artificial Sequence
  Synthetically generated peptide
EVQLLESGGGLVQPGGSLRLSCAASGFTFSHYWMRWVRQAPGKGLEWVSSIGSSGGMTKYADSVKGRFTISRDNSKNTLYLQMNSLRAEDTAVYYCARALRWRAFDIWGQGTMVTVSSASTKGPSVFPLAP

SEQ ID NO: 421 - protein, 14 aa, Artificial Sequence
  Synthetically generated peptide
SGTSSDVGAYYHVS

SEQ ID NO: 422 - protein, 7 aa, Artificial Sequence
  Synthetically generated peptide
EVTNRPS

SEQ ID NO: 423 - protein, 10 aa, Artificial Sequence
  Synthetically generated peptide
SSYTTSNTLV

SEQ ID NO: 424 - protein, 5 aa, Artificial Sequence
  Synthetically generated peptide
WYVMR

SEQ ID NO: 425 - protein, 17 aa, Artificial Sequence
  Synthetically generated peptide
SIYPSGGQTRYADSVKG

SEQ ID NO: 426 - protein, 131 aa, Artificial Sequence
  Synthetically generated peptide
EVQLLESGGGLVQPGGSLRLSCAASGFTFSNYFMNWVRQAPGKGLEWVSSIGSSGGYTRYADSVKGRFTISRDNSKNTLYLQMNSLRAEDTAVYYCARVGVWYGMDVWGQGTTVTVSSASTKGPSVFPLAP

SEQ ID NO: 427 - protein, 11 aa, Artificial Sequence
  Synthetically generated peptide
RASQSVSSNLA

SEQ ID NO: 428 - protein, 7 aa, Artificial Sequence
  Synthetically generated peptide
GASTRAT

SEQ ID NO: 429 - protein, 11 aa, Artificial Sequence
  Synthetically generated peptide
QQNNNWPPSFT

SEQ ID NO: 430 - protein, 5 aa, Artificial Sequence
  Synthetically generated peptide
HYTML

SEQ ID NO: 431 - protein, 17 aa, Artificial Sequence
  Synthetically generated peptide
SIYSSGGSTYYADSVKG

SEQ ID NO: 432 - protein, 131 aa, Artificial Sequence
  Synthetically generated peptide
EVQLLESGGGLVQPGGSLRLSCAASGFTFSHYVMDWVRQAPGKGLEWVSSIYPSGGWTRYADSVKGRFTISRDNSRNTLYLQMNSLRAEDTAVYYCARRGQWLVLDYWGQGTLVTVSSASTKGPSVFPLAP

SEQ ID NO: 433 - protein, 12 aa, Artificial Sequence
  Synthetically generated peptide
RASQSVSSSYLA

SEQ ID NO: 434 - protein, 133 aa, Artificial Sequence
  Synthetically generated peptide
EVQLLESGGGLVQPGGSLRLSCAASGFTFSHYVMGWVRQAPGKGLEWVSSIYPSGGKTTYADSVKGRFTISRDNSKNTLYLQMNSLRAEDTAVYYCASPSTGSWSAFDIWGQGTMVTVSSASTKGPSVFPLAP

SEQ ID NO: 435 - protein, 9 aa, Artificial Sequence
  Synthetically generated peptide
QQYGSSRYT

SEQ ID NO: 436 - protein, 5 aa, Artificial Sequence
  Synthetically generated peptide
NYTMF

SEQ ID NO: 437 - protein, 17 aa, Artificial Sequence
  Synthetically generated peptide
SIYPSGGITRYADSVKG

SEQ ID NO: 438 - protein, 9 aa, Artificial Sequence
  Synthetically generated peptide
VSFWNAFDI

SEQ ID NO: 439 - protein, 11 aa, Artificial Sequence
  Synthetically generated peptide
RASQTISSYLN

SEQ ID NO: 440 - protein, 7 aa, Artificial Sequence
  Synthetically generated peptide
TTSSLQS

SEQ ID NO: 441 - protein, 8 aa, Artificial Sequence
  Synthetically generated peptide
QQSHSSPT

SEQ ID NO: 442 - protein, 5 aa, Artificial Sequence
  Synthetically generated peptide
HYLMY

SEQ ID NO: 443 - protein, 17 aa, Artificial Sequence
  Synthetically generated peptide
SIYPSGGFTAYADSVKG

SEQ ID NO: 444 - protein, 9 aa, Artificial Sequence
  Synthetically generated peptide
RGVYGTFDI

SEQ ID NO: 445 - protein, 11 aa, Artificial Sequence
  Synthetically generated peptide
RASQDVRRFLA

SEQ ID NO: 446 - protein, 132 aa, Artificial Sequence
  Synthetically generated peptide
EVQLLESGGGLVQPGGSLRLSCAASGFTFSHYKMHWVRQAPGKGLEWVSSIWPSGGGTFYADSVKGRFTISRDNSKNTLYLQMNSLRAEDTAMYYCARTSGGFGAFDIWGQGTMVTVSSASTKGPSVFPLAP

SEQ ID NO: 447 - protein, 9 aa, Artificial Sequence
  Synthetically generated peptide
QQANSFPIT

SEQ ID NO: 448 - protein, 5 aa, Artificial Sequence
  Synthetically generated peptide
HYPMS

SEQ ID NO: 449 - protein, 16 aa, Artificial Sequence
  Synthetically generated peptide
YIRSGGYTTYADSVKG

SEQ ID NO: 450 - protein, 16 aa, Artificial Sequence
  Synthetically generated peptide
ERVFCSGGRCGSYFDY

SEQ ID NO: 451 - protein, 12 aa, Artificial Sequence
  Synthetically generated peptide
RASQSVYSSYLA

SEQ ID NO: 452 - protein, 3 aa, Artificial Sequence
  Synthetically generated peptide
ANR

SEQ ID NO: 453 - protein, 8 aa, Artificial Sequence
  Synthetically generated peptide
QQSYSTPR

SEQ ID NO: 454 - protein, 5 aa, Artificial Sequence
  Synthetically generated peptide
RYAMF

SEQ ID NO: 455 - protein, 17 aa, Artificial Sequence
  Synthetically generated peptide
SISPSGGKTRYADSVKG

SEQ ID NO: 456 - protein, 8 aa, Artificial Sequence
  Synthetically generated peptide
GGGTALDY

SEQ ID NO: 457 - protein, 11 aa, Artificial Sequence
  Synthetically generated peptide
RASQSISSWLA

SEQ ID NO: 458 - protein, 7 aa, Artificial Sequence
  Synthetically generated peptide
AASSLRN

SEQ ID NO: 459 - protein, 9 aa, Artificial Sequence
  Synthetically generated peptide
QQSYSTPPT

SEQ ID NO: 460 - protein, 5 aa, Artificial Sequence
  Synthetically generated peptide
RYWMA

SEQ ID NO: 461 - protein, 17 aa, Artificial Sequence
  Synthetically generated peptide
SIGPSGGSTKYADSVKG

SEQ ID NO: 462 - protein, 9 aa, Artificial Sequence
  Synthetically generated peptide
TARWLSFDY

SEQ ID NO: 463 - protein, 12 aa, Artificial Sequence
  Synthetically generated peptide
RASQSVSSNYLA

SEQ ID NO: 464 - protein, 129 aa, Artificial Sequence
  Synthetically generated peptide
EVQLLESGGGLVQPGGSLRLSCAASGFTFSHYWMMWVRQAPGKGLEWVSWIGSSGGFTWYADSVKGRFTISRDNSKNTLYLQMNSLRAEDTAVYYCARGNGGFDSWGQGTLVTVSSASTKGPSVFPLAP

SEQ ID NO: 465 - protein, 9 aa, Artificial Sequence
  Synthetically generated peptide
QQFGSSLFT

SEQ ID NO: 466 - protein, 5 aa, Artificial Sequence
  Synthetically generated peptide
NYYML

SEQ ID NO: 467 - protein, 17 aa, Artificial Sequence
  Synthetically generated peptide
YIRSSGGSTRYADSVKG

SEQ ID NO: 468 - protein, 9 aa, Artificial Sequence
  Synthetically generated peptide
PTVDGAFDY

SEQ ID NO: 469 - protein, 14 aa, Artificial Sequence
  Synthetically generated peptide
AGTSSDLGGYDYVS

SEQ ID NO: 470 - protein, 7 aa, Artificial Sequence
  Synthetically generated peptide
QVGRRPS

SEQ ID NO: 471 - protein, 10 aa, Artificial Sequence
  Synthetically generated peptide
SSYTSSRTRV

SEQ ID NO: 472 - protein, 5 aa, Artificial Sequence
  Synthetically generated peptide
HYVMD

SEQ ID NO: 473 - protein, 17 aa, Artificial Sequence
  Synthetically generated peptide
SIYPSGGWTRYADSVKG

SEQ ID NO: 474 - protein, 9 aa, Artificial Sequence
  Synthetically generated peptide
RGQWLVLDY

SEQ ID NO: 475 - protein, 14 aa, Artificial Sequence
  Synthetically generated peptide
TGTSSDVGGFNYVS

SEQ ID NO: 476 - protein, 7 aa, Artificial Sequence
  Synthetically generated peptide
DVSKRPS

SEQ ID NO: 477 - protein, 10 aa, Artificial Sequence
  Synthetically generated peptide
CSYTGNYTYV

SEQ ID NO: 478 - protein, 5 aa, Artificial Sequence
  Synthetically generated peptide
RYAMA

SEQ ID NO: 479 - protein, 17 aa, Artificial Sequence
  Synthetically generated peptide
SIGSSGGVTKYADSVKG

SEQ ID NO: 480 - protein, 20 aa, Artificial Sequence
  Synthetically generated peptide
PRGRYYYDSSGYYYGGVFDY

SEQ ID NO: 481 - protein, 11 aa, Artificial Sequence
  Synthetically generated peptide
RASQGISNYLA

SEQ ID NO: 482 - protein, 7 aa, Artificial Sequence
  Synthetically generated peptide
AASTLQS

SEQ ID NO: 483 - protein, 9 aa, Artificial Sequence
  Synthetically generated peptide
QQSYSTPYT

SEQ ID NO: 484 - protein, 5 aa, Artificial Sequence
  Synthetically generated peptide
QYLMA

SEQ ID NO: 485 - protein, 17 aa, Artificial Sequence
  Synthetically generated peptide
SIYPSGGNTNYADSVKG

SEQ ID NO: 486 - protein, 23 aa, Artificial Sequence
  Synthetically generated peptide
DRSIVPYSSSWYMPRDYYYGMDV

SEQ ID NO: 487 - protein, 12 aa, Artificial Sequence
  Synthetically generated peptide
RASQSVSSSYLA

SEQ ID NO: 488 - protein, 7 aa, Artificial Sequence
  Synthetically generated peptide
GAASRAT

SEQ ID NO: 489 - protein, 10 aa, Artificial Sequence
  Synthetically generated peptide
QQYGSSPLIT

SEQ ID NO: 490 - protein, 5 aa, Artificial Sequence
  Synthetically generated peptide
HYPMT

SEQ ID NO: 491 - protein, 17 aa, Artificial Sequence
  Synthetically generated peptide
SIRPSGGNTGYADSVKG

SEQ ID NO: 492 - protein, 16 aa, Artificial Sequence
  Synthetically generated peptide
LTGYSSGWFWAYGMDV

SEQ ID NO: 493 - protein, 14 aa, Artificial Sequence
  Synthetically generated peptide
TGTSSDVGGYNYVS

SEQ ID NO: 494 - protein, 7 aa, Artificial Sequence
  Synthetically generated peptide
EVSNRAS

SEQ ID NO: 495 - protein, 10 aa, Artificial Sequence
  Synthetically generated peptide
SSYTSSTTLL

SEQ ID NO: 496 - protein, 5 aa, Artificial Sequence
  Synthetically generated peptide
RYVMA

SEQ ID NO: 497 - protein, 28 aa, Artificial Sequence
  Synthetically generated peptide
VIRPSGGKTLYADSVKGRASQGISSWLA

SEQ ID NO: 498 - protein, 17 aa, Artificial Sequence
  Synthetically generated peptide
VAGRVGVPATKKNWFDP

SEQ ID NO: 499 - protein, 131 aa, Artificial Sequence
  Synthetically generated peptide
EVQLLESGGGLVQPGGSLRLSCAASGFTFSNYTMMWVRQAPGKGLEWVSGIYPSGGQTAYADSVKGRFTISRDNSKNTLYLQMNSLRAEDTAVYYCARGGSWYAFDIWGQGTMVTVSSASTKGPSVFPLAP

SEQ ID NO: 500 - protein, 127 aa, Artificial Sequence
  Synthetically generated peptide
EVQLLESGGGLVQPGGSLRLSCAASGFTFSNYPMHWVRQAPGKGLEWVSYIGPSGGWTRYADSVKGRFTISRDNSKNTLYLQMNSLRAEDTAVYYCARAPSGYWGQGTLVTVSSASTKGPSVFPLAP

SEQ ID NO: 501 - protein, 9 aa, Artificial Sequence
  Synthetically generated peptide
QQANSFPLT

SEQ ID NO: 502 - protein, 5 aa, Artificial Sequence
  Synthetically generated peptide
PYTMS

SEQ ID NO: 503 - protein, 17 aa, Artificial Sequence
  Synthetically generated peptide
GIYPSGGETWYADSVKG

SEQ ID NO: 504 - protein, 15 aa, Artificial Sequence
  Synthetically generated peptide
NINLRYDILTGYFDF

SEQ ID NO: 505 - protein, 12 aa, Artificial Sequence
  Synthetically generated peptide
RASQSVSSSYLA

SEQ ID NO: 506 - protein, 130 aa, Artificial Sequence
  Synthetically generated peptide
EVQLLESGGGLVQPGGSLRLSCAASGFTFSHYYMMWVRQAPGKGLEWVSSIGPSGGMTDYADSVKGRFTISRDNSKNTLYLQMNSLRAEDTAVYYCATGGTASLDYWGQGTLVTVSSASTKGPSVFPLAP

SEQ ID NO: 507 - protein, 9 aa, Artificial Sequence
  Synthetically generated peptide
QQYGSSGWT

SEQ ID NO: 508 - protein, 5 aa, Artificial Sequence
  Synthetically generated peptide
YYRMT

SEQ ID NO: 509 - protein, 17 aa, Artificial Sequence
  Synthetically generated peptide
SIYPSGGYTIYADSVKG

SEQ ID NO: 510 - protein, 9 aa, Artificial Sequence
  Synthetically generated peptide
LGQWLALDH

SEQ ID NO: 511 - protein, 11 aa, Artificial Sequence
  Synthetically generated peptide
QGDSLRSYYAS

SEQ ID NO: 512 - protein, 7 aa, Artificial Sequence
  Synthetically generated peptide
SKSNRPS

SEQ ID NO: 513 - protein, 11 aa, Artificial Sequence
  Synthetically generated peptide
NSRDSSGNHLV

SEQ ID NO: 514 - protein, 5 aa, Artificial Sequence
  Synthetically generated peptide
KYWMA

SEQ ID NO: 515 - protein, 17 aa, Artificial Sequence
  Synthetically generated peptide
VIYPSGGQTKYADSVKG

SEQ ID NO: 516 - protein, 9 aa, Artificial Sequence
  Synthetically generated peptide
MRYGDRFDY

SEQ ID NO: 517 - protein, 11 aa, Artificial Sequence
  Synthetically generated peptide
RASQGISSYLA

SEQ ID NO: 518 - protein, 7 aa, Artificial Sequence
  Synthetically generated peptide
AASTLQS

SEQ ID NO: 519 - protein, 9 aa, Artificial Sequence
  Synthetically generated peptide
QQLNSYPRT

SEQ ID NO: 520 - protein, 5 aa, Artificial Sequence
  Synthetically generated peptide
RYWMH

SEQ ID NO: 521 - protein, 17 aa, Artificial Sequence
  Synthetically generated peptide
SIGPSGGVTKYADSVKG

SEQ ID NO: 522 - protein, 9 aa, Artificial Sequence
  Synthetically generated peptide
HGSWGGMDV

SEQ ID NO: 523 - protein, 14 aa, Artificial Sequence
  Synthetically generated peptide
TGTTSDVGGYKYVS

SEQ ID NO: 524 - protein, 7 aa, Artificial Sequence
  Synthetically generated peptide
EVNHRPS

SEQ ID NO: 525 - protein, 11 aa, Artificial Sequence
  Synthetically generated peptide
YSYTSDSTPYV

SEQ ID NO: 526 - protein, 5 aa, Artificial Sequence
  Synthetically generated peptide
RYAMH

SEQ ID NO: 527 - protein, 17 aa, Artificial Sequence
  Synthetically generated peptide
SIWPSGGATFYADSVKG

SEQ ID NO: 528 - protein, 9 aa, Artificial Sequence
  Synthetically generated peptide
SPTLNAFHI

SEQ ID NO: 529 - protein, 11 aa, Artificial Sequence
  Synthetically generated peptide
RASQSISNWLA

SEQ ID NO: 530 - protein, 7 aa, Artificial Sequence
  Synthetically generated peptide
KASTLES

SEQ ID NO: 531 - protein, 8 aa, Artificial Sequence
  Synthetically generated peptide
QHYNSYSL

SEQ ID NO: 532 - protein, 5 aa, Artificial Sequence
  Synthetically generated peptide
HYTMV

SEQ ID NO: 533 - protein, 17 aa, Artificial Sequence
  Synthetically generated peptide
SIYSSGGRTNYADSVKG

SEQ ID NO: 534 - protein, 17 aa, Artificial Sequence
  Synthetically generated peptide
IVVVPSAQFYFYYGMDV

SEQ ID NO: 535 - protein, 14 aa, Artificial Sequence
  Synthetically generated peptide
TGTSNDIGRTNYVS

SEQ ID NO: 536 - protein, 128 aa, Artificial Sequence
  Synthetically generated peptide
EVQLLESGGGLVQPGGSLRLSCAASGFTFSHYLMGWVRQAPGKGLEWVSSIWPSGGHTSYADSVKGRFTISRDNSKNTLYLQMNSLRAEDTAVYYCARHYGMDVWGQGTTVTVSSASTKGPSVFPLAP

SEQ ID NO: 537 - protein, 10 aa, Artificial Sequence
  Synthetically generated peptide
SSCTTAPVCV

SEQ ID NO: 538 - protein, 5 aa, Artificial Sequence
  Synthetically generated peptide
LYAMH

SEQ ID NO: 539 - protein, 17 aa, Artificial Sequence
  Synthetically generated peptide
SIRPSGGLTKYADSVKG

SEQ ID NO: 540 - protein, 131 aa, Artificial Sequence
  Synthetically generated peptide
EVQLLESGGGLVQPGGSLRLSCAASGFTFSHYKMNWVRQAPGKGLEWVSYIGSSGGKTGYADSVKGRFTISRDNSKNTLYLQMNSLRAEDTALYYCARVGVWYGMDVWGQGTLVTVSSASTKGPSVFPLAP

SEQ ID NO: 541 - protein, 13 aa, Artificial Sequence
  Synthetically generated peptide
SGSSSNIGSNYVY

SEQ ID NO: 542 - protein, 7 aa, Artificial Sequence
  Synthetically generated peptide
SNNQRPS

SEQ ID NO: 543 - protein, 11 aa, Artificial Sequence
  Synthetically generated peptide
ATWDNSLSAWV

SEQ ID NO: 544 - protein, 5 aa, Artificial Sequence
  Synthetically generated peptide
HYVMN

SEQ ID NO: 545 - protein, 17 aa, Artificial Sequence
  Synthetically generated peptide
RIYPSGGVTVYADSVKG

SEQ ID NO: 546 - protein, 6 aa, Artificial Sequence
  Synthetically generated peptide
GYGMDV

SEQ ID NO: 547 - protein, 11 aa, Artificial Sequence
  Synthetically generated peptide
RASQSVGNSLA

SEQ ID NO: 548 - protein, 7 aa, Artificial Sequence
  Synthetically generated peptide
GASTRAS

SEQ ID NO: 549 - protein, 9 aa, Artificial Sequence
  Synthetically generated peptide
QEYNKWPIT

SEQ ID NO: 550 - protein, 5 aa, Artificial Sequence
  Synthetically generated peptide
WYWMY

SEQ ID NO: 551 - protein, 17 aa, Artificial Sequence
  Synthetically generated peptide
VIGSSGGVTKYADSVKG

SEQ ID NO: 552 - protein, 9 aa, Artificial Sequence
  Synthetically generated peptide
GPYRGYFDY

SEQ ID NO: 553 - protein, 11 aa, Artificial Sequence
  Synthetically generated peptide
RASQSISSYLS

SEQ ID NO: 554 - protein, 5 aa, Artificial Sequence
  Synthetically generated peptide
SNLQS

SEQ ID NO: 555 - protein, 9 aa, Artificial Sequence
  Synthetically generated peptide
QQIYRTPLT

SEQ ID NO: 556 - protein, 5 aa, Artificial Sequence
  Synthetically generated peptide
WYQMM

SEQ ID NO: 557 - protein, 18 aa, Artificial Sequence
  Synthetically generated peptide
SYIRSSGGKTDYADSVKG

SEQ ID NO: 558 - protein, 129 aa, Artificial Sequence
  Synthetically generated peptide
EVQLLESGGGLVQPGGSLRLSCAASGFTFSFYPMSWVRQAPGKGLEWVSYIWPSGGATRYADSVKGRFTISRDNSKNTLYLQMNSLRAEDTAVYYCARGNGGFDSWGQGTLVTVSSASTKGPSVFPLAP

SEQ ID NO: 559 - protein, 12 aa, Artificial Sequence
  Synthetically generated peptide
RASQSVGSDYLA

SEQ ID NO: 560 - protein, 131 aa, Artificial Sequence
  Synthetically generated peptide
EVQLLESGGGLVQPGGSLRLSCAASGFTFSFYVMGWVRQAPGKGLEWVSWIGPSGGRTWYADSVKGRFTISRDNSKNTLYLQMNSLRAEDTAVYYCARDRGWYGIDVWGQGTTVTVSSASTKGPSVFPLAP

SEQ ID NO: 561 - protein, 9 aa, Artificial Sequence
  Synthetically generated peptide
QQYGSSLYT

SEQ ID NO: 562 - protein, 5 aa, Artificial Sequence
  Synthetically generated peptide
NYKMS

SEQ ID NO: 563 - protein, 17 aa, Artificial Sequence
  Synthetically generated peptide
GIYPSGGLTQYADSVKG

SEQ ID NO: 564 - protein, 131 aa, Artificial Sequence
  Synthetically generated peptide
EVQLLESGGGLVQPGGSLRLSCAASGFTFSRYWMHWVRQAPGKGLEWVSSIGPSGGVTKYADSVKGRFTISRDNSKNTLYLQMNSLRAEDTAVYYCARHGSWGGMDVWGQGTTVTVSSASTKGPSVFPLAP

SEQ ID NO: 565 - protein, 11 aa, Artificial Sequence
  Synthetically generated peptide
RAGQTINNYLN

SEQ ID NO: 566 - protein, 5 aa, Artificial Sequence
  Synthetically generated peptide
ANLQS

SEQ ID NO: 567 - protein, 7 aa, Artificial Sequence
  Synthetically generated peptide
QQYTPFT

SEQ ID NO: 568 - protein, 5 aa, Artificial Sequence
  Synthetically generated peptide
HYKMH

SEQ ID NO: 569 - protein, 17 aa, Artificial Sequence
  Synthetically generated peptide
SIWPSGGGTFYADSVKG

SEQ ID NO: 570 - protein, 10 aa, Artificial Sequence
  Synthetically generated peptide
TSGGFGAFDI

SEQ ID NO: 571 - protein, 131 aa, Artificial Sequence
  Synthetically generated peptide
EVQLLESGGGLVQPGGSLRLSCAASGFTFSNYSMVWVRQAPGKGLEWVSRIYSSGGSTHYADSVKGRFTISRDNSKNTLYLQMNSLRAEDTAVYYCARVGVWYGMDVWGQGTTVTVSSASTKGPSVFPLAP

SEQ ID NO: 572 - protein, 131 aa, Artificial Sequence
  Synthetically generated peptide
EVQLLESGGGLVQPGGSLRLSCAASGFTFSWYTMGWVRQAPGKGLEWVSVIYPSGGMTKYADSVKGRFTISRDNSKNTLYLQMNSLRAEDTAVYYCARTSGGTPWGFWGQGTLVTVSSASTKGPSVFPLAP

SEQ ID NO: 573 - protein, 9 aa, Artificial Sequence
  Synthetically generated peptide
QQSYSTPRT

SEQ ID NO: 574 - protein, 5 aa, Artificial Sequence
  Synthetically generated peptide
HYYMM

SEQ ID NO: 575 - protein, 17 aa, Artificial Sequence
  Synthetically generated peptide
SIGPSGGMTDYADSVKG

SEQ ID NO: 576 - protein, 8 aa, Artificial Sequence
  Synthetically generated peptide
GGTASLDY

SEQ ID NO: 577 - protein, 12 aa, Artificial Sequence
  Synthetically generated peptide
RASQSVSSSYLA

SEQ ID NO: 578 - protein, 131 aa, Artificial Sequence
  Synthetically generated peptide
EVQLLESGGGLVQPGGSLRLSCAASGFTFSHYVMSWVRQAPGKGLEWVSYIYPSGGKTHYADSVKGRFTISRDNSKNTLYLQMNSLRAEDTAVYYCARVGVWYGMDVWGQGTTVTVSSASTKGPSVFPLAP

SEQ ID NO: 579 - protein, 9 aa, Artificial Sequence
  Synthetically generated peptide
QQYGSSSYT

SEQ ID NO: 580 - protein, 5 aa, Artificial Sequence
  Synthetically generated peptide
HYVMG

SEQ ID NO: 581 - protein, 17 aa, Artificial Sequence
  Synthetically generated peptide
SIYPSGGKTTYADSVKG

SEQ ID NO: 582 - protein, 11 aa, Artificial Sequence
  Synthetically generated peptide
PSTGSWSAFDI

SEQ ID NO: 583 - protein, 14 aa, Artificial Sequence
  Synthetically generated peptide
TGTSSDVGGYNYVS

SEQ ID NO: 584 - protein, 7 aa, Artificial Sequence
  Synthetically generated peptide
DVSKRPS

SEQ ID NO: 585 - protein, 11 aa, Artificial Sequence
  Synthetically generated peptide
SSYTSSITLVV

SEQ ID NO: 586 - protein, 5 aa, Artificial Sequence
  Synthetically generated peptide
WYAMH

SEQ ID NO: 587 - protein, 17 aa, Artificial Sequence
  Synthetically generated peptide
VISPSGGATRYADSVKG

SEQ ID NO: 588 - protein, 10 aa, Artificial Sequence
  Synthetically generated peptide
ASTVTTLFQH

SEQ ID NO: 589 - protein, 11 aa, Artificial Sequence
  Synthetically generated peptide
RASQSISSWLA

SEQ ID NO: 590 - protein, 7 aa, Artificial Sequence
  Synthetically generated peptide
AASTLQS

SEQ ID NO: 591 - protein, 9 aa, Artificial Sequence
  Synthetically generated peptide
QKYNSAPLT

SEQ ID NO: 592 - protein, 5 aa, Artificial Sequence
  Synthetically generated peptide
NYHMQ

SEQ ID NO: 593 - protein, 17 aa, Artificial Sequence
  Synthetically generated peptide
SIYPSGGFTRYADSVKG

SEQ ID NO: 594 - protein, 6 aa, Artificial Sequence
  Synthetically generated peptide
DGGQGG

SEQ ID NO: 595 - protein, 131 aa, Artificial Sequence
  Synthetically generated peptide
EVQLLESGGGLVQPGGSLRLSCAASGFTFSHYNMNWVRQAPGKGLEWVSVIYPSGGQTHYADSVKGRFTISRDNSKNTLYLQMNSLRAEDTAVYYCARRGIWHSFDIWGQGTMVTVSSASTKGPSVFPLAP

SEQ ID NO: 596 - protein, 141 aa, Artificial Sequence
  Synthetically generated peptide
EVQLLESGGGLVQPGGSLRLSCAASGFTFSWYNMYWVRQAPGKGLEWVSYIVPSGGATHYADSVKGRFTISRDNSKNTLYLQMNSLRAEDTAVYYCARALRGYSYGPRGYYYYGMDVWGQGTTVTVSSASTKGPSVFPLAP

SEQ ID NO: 597 - protein, 8 aa, Artificial Sequence
  Synthetically generated peptide
QQTFSTWT

SEQ ID NO: 598 - protein, 5 aa, Artificial Sequence
  Synthetically generated peptide
HYLMG

SEQ ID NO: 599 - protein, 17 aa, Artificial Sequence
  Synthetically generated peptide
SIWPSGGHTSYADSVKG

SEQ ID NO: 600 - protein, 6 aa, Artificial Sequence
  Synthetically generated peptide
HYGMDV

SEQ ID NO: 601 - protein, 12 aa, Artificial Sequence
  Synthetically generated peptide
RASQSVSSSYLA

SEQ ID NO: 602 - protein, 131 aa, Artificial Sequence
  Synthetically generated peptide
EVQLLESGGGLVQPGGSLRLSCAASGFTFSHYVMQWVRQAPGKGLEWVSGIGPSGGSTTYADSVKGRFTISRDNSKNTLYLQMNSLRAEDTAVYYCARVGVWYGMDVWGQGTTVTVSSASTKGPSVFPLAP

SEQ ID NO: 603 - protein, 10 aa, Artificial Sequence
  Synthetically generated peptide
QQYNNWPPLT

SEQ ID NO: 604 - protein, 5 aa, Artificial Sequence
  Synthetically generated peptide
RYMMY

SEQ ID NO: 605 - protein, 17 aa, Artificial Sequence
  Synthetically generated peptide
SIYPSGGKTLYADSVKG

SEQ ID NO: 606 - protein, 142 aa, Artificial Sequence
  Synthetically generated peptide
EVQLLESGGGLVQPGGSLRLSCAASGFTFSRYAMGWVRQAPGKGLEWVSYIGPSGGNTTYADSVKGRFTISRDNSKNTLYLQMNSLRAEDTAVYYCARDVGGSGSYYMLSYYYYGMDVWGQGTMVTVSSASTKGPSVFPLAP

SEQ ID NO: 607 - protein, 11 aa, Artificial Sequence
  Synthetically generated peptide
RASHNIYTSLN

SEQ ID NO: 608 - protein, 7 aa, Artificial Sequence
  Synthetically generated peptide
GASTLEN

SEQ ID NO: 609 - protein, 8 aa, Artificial Sequence
  Synthetically generated peptide
QQSYTSVT

SEQ ID NO: 610 - protein, 5 aa, Artificial Sequence
  Synthetically generated peptide
FYSMM

SEQ ID NO: 611 - protein, 17 aa, Artificial Sequence
  Synthetically generated peptide
GISSSGGTTKYADSVKG

SEQ ID NO: 612 - protein, 23 aa, Artificial Sequence
  Synthetically generated peptide
GGTNYDYVWGSYRSHYYYYGMDV

SEQ ID NO: 613 - protein, 11 aa, Artificial Sequence
  Synthetically generated peptide
RASQSISSWLA

SEQ ID NO: 614 - protein, 7 aa, Artificial Sequence
  Synthetically generated peptide
TASSLES

SEQ ID NO: 615 - protein, 9 aa, Artificial Sequence
  Synthetically generated peptide
QQYNSYSLT

SEQ ID NO: 616 - protein, 5 aa, Artificial Sequence
  Synthetically generated peptide
NYKMQ

SEQ ID NO: 617 - protein, 17 aa, Artificial Sequence
  Synthetically generated peptide
SIYSSGGKTVYADSVKG

SEQ ID NO: 618 - protein, 9 aa, Artificial Sequence
  Synthetically generated peptide
TPGYNYFDY

SEQ ID NO: 619 - protein, 11 aa, Artificial Sequence
  Synthetically generated peptide
RASQTFNNYLN

SEQ ID NO: 620 - protein, 7 aa, Artificial Sequence
  Synthetically generated peptide
AASTLQS

SEQ ID NO: 621 - protein, 129 aa, Artificial Sequence
  Synthetically generated peptide
EVQLLESGGGLVQPGGSLRLSCAASGFTFSHYVMQWVRQAPGKGLEWVSSIYPSGGSTRYADSVKGRFTISRDNSKNTLYLQMNSLRAEDTAMYYCARFNVGFDLWGRGTLVTVSSASTKGPSVFPLAP

SEQ ID NO: 622 - protein, 5 aa, Artificial Sequence
  Synthetically generated peptide
HYLMF

SEQ ID NO: 623 - protein, 17 aa, Artificial Sequence
  Synthetically generated peptide
SIWPSGGNTKYADSVKG

SEQ ID NO: 624 - protein, 9 aa, Artificial Sequence
  Synthetically generated peptide
PAYYYAMDV

SEQ ID NO: 625 - protein, 12 aa, Artificial Sequence
  Synthetically generated peptide
RASQTVGGSYLA

SEQ ID NO: 626 - protein, 5 aa, Artificial Sequence
  Synthetically generated peptide
ANRAP

SEQ ID NO: 627 - protein, 9 aa, Artificial Sequence
  Synthetically generated peptide
QQYGSSMYT

SEQ ID NO: 628 - protein, 5 aa, Artificial Sequence
  Synthetically generated peptide
WYQMS

SEQ ID NO: 629 - protein, 17 aa, Artificial Sequence
  Synthetically generated peptide
SIYPSGGATKYADSVKG

SEQ ID NO: 630 - protein, 9 aa, Artificial Sequence
  Synthetically generated peptide
MGLHHSFDY

SEQ ID NO: 631 - protein, 138 aa, Artificial Sequence
  Synthetically generated peptide
EVQLLESGGGLVQPGGSLRLSCAASGFTFSSYAMTWVRQAPGKGLEWVSSISSSGGDTAYADSVKGRFTISRDNSKNTLYLQMNSLRAEDTAVYYCATERHYIWGSYRYSWFDPWGQGTLVTVSSASTKGPSVFPLAP

SEQ ID NO: 632 - protein, 127 aa, Artificial Sequence
  Synthetically generated peptide
EVQLLESGGGLVQPGGSLRLSCAASGFTFSRYLMWWVRQAPGKGLEWVSVIGPSGGWTRYADSVKGRFTISRDNSKNTLYLQMNSLRAEDTAVYYCARHPGDYWGQGTLVTVSSASTKGPSVFPLAP

SEQ ID NO: 633 - protein, 9 aa, Artificial Sequence
  Synthetically generated peptide
QQANSFPLT

SEQ ID NO: 634 - protein, 5 aa, Artificial Sequence
  Synthetically generated peptide
HYWMR

SEQ ID NO: 635 - protein, 17 aa, Artificial Sequence
  Synthetically generated peptide
SIGSSGGMTKYADSVKG

SEQ ID NO: 636 - protein, 9 aa, Artificial Sequence
  Synthetically generated peptide
ALRWRAFDI

SEQ ID NO: 637 - protein, 14 aa, Artificial Sequence
  Synthetically generated peptide
TGTNTDVGGYNYVS

SEQ ID NO: 638 - protein, 7 aa, Artificial Sequence
  Synthetically generated peptide
EVNHRPS

SEQ ID NO: 639 - protein, 8 aa, Artificial Sequence
  Synthetically generated peptide
SSYYNTYV

SEQ ID NO: 640 - protein, 5 aa, Artificial Sequence
  Synthetically generated peptide
WYTMG

SEQ ID NO: 641 - protein, 17 aa, Artificial Sequence
  Synthetically generated peptide
VIYPSGGMTKYADSVKG

SEQ ID NO: 642 - protein, 9 aa, Artificial Sequence
  Synthetically generated peptide
TSGGTPWGF

SEQ ID NO: 643 - protein, 12 aa, Artificial Sequence
  Synthetically generated peptide
RASQTVSSNYLA

SEQ ID NO: 644 - protein, 7 aa, Artificial Sequence
  Synthetically generated peptide
GVSNRAA

SEQ ID NO: 645 - protein, 9 aa, Artificial Sequence
  Synthetically generated peptide
QHYGSSAFT

SEQ ID NO: 646 - protein, 5 aa, Artificial Sequence
  Synthetically generated peptide
NYIMS

SEQ ID NO: 647 - protein, 17 aa, Artificial Sequence
  Synthetically generated peptide
SIWPSGGHTRYADSVKG

SEQ ID NO: 648 - protein, 9 aa, Artificial Sequence
  Synthetically generated peptide
AGSYYAGDY

SEQ ID NO: 649 - protein, 11 aa, Artificial Sequence
  Synthetically generated peptide
RASQDVLVSFA

SEQ ID NO: 650 - protein, 7 aa, Artificial Sequence
  Synthetically generated peptide
AASHLHP

SEQ ID NO: 651 - protein, 9 aa, Artificial Sequence
  Synthetically generated peptide
QQARSFPHT

SEQ ID NO: 652 - protein, 5 aa, Artificial Sequence
  Synthetically generated peptide
WYSMT

SEQ ID NO: 653 - protein, 17 aa, Artificial Sequence
  Synthetically generated peptide
SISPSGGATKYADSVKG

SEQ ID NO: 654 - protein, 10 aa, Artificial Sequence
  Synthetically generated peptide
GGAASLPFDY

SEQ ID NO: 655 - protein, 11 aa, Artificial Sequence
  Synthetically generated peptide
FGDKLGDKYGS

SEQ ID NO: 656 - protein, 7 aa, Artificial Sequence
  Synthetically generated peptide
QYWKRPS

SEQ ID NO: 657 - protein, 9 aa, Artificial Sequence
  Synthetically generated peptide
QAWDSNTVV

SEQ ID NO: 658 - protein, 5 aa, Artificial Sequence
  Synthetically generated peptide
NYKMH

SEQ ID NO: 659 - protein, 17 aa, Artificial Sequence
  Synthetically generated peptide
SIYPSGGWTVYADSVKG

SEQ ID NO: 660 - protein, 131 aa, Artificial Sequence
  Synthetically generated peptide
EVQLLESGGGLVQPGGSLRLSCAASGFTFSLYFMTWVRQAPGKGLEWVSSISSSGGSTKYADSVKGRFTISRDNSKNTLYLQMNSLRAEDTAVYYCARGGQWLAFDYWGQGTLVTVSSASTKGPSVFPLAP

SEQ ID NO: 661 - protein, 11 aa, Artificial Sequence
  Synthetically generated peptide
RASQYISTYLA

SEQ ID NO: 662 - protein, 7 aa, Artificial Sequence
  Synthetically generated peptide
KASDLES

SEQ ID NO: 663 - protein, 8 aa, Artificial Sequence
  Synthetically generated peptide
QQYNTYWT

SEQ ID NO: 664 - protein, 5 aa, Artificial Sequence
  Synthetically generated peptide
FYVMG

SEQ ID NO: 665 - protein, 17 aa, Artificial Sequence
  Synthetically generated peptide
WIGPSGGRTWYADSVKG

SEQ ID NO: 666 - protein, 9 aa, Artificial Sequence
  Synthetically generated peptide
DRGWYGIDV

SEQ ID NO: 667 - protein, 11 aa, Artificial Sequence
  Synthetically generated peptide
SGNILDNSYAS

SEQ ID NO: 668 - protein, 7 aa, Artificial Sequence
  Synthetically generated peptide
RDNKRPS

SEQ ID NO: 669 - protein, 9 aa, Artificial Sequence
  Synthetically generated peptide
QAWDRTTGV

SEQ ID NO: 670 - protein, 5 aa, Artificial Sequence
  Synthetically generated peptide
WYNMY

SEQ ID NO: 671 - protein, 17 aa, Artificial Sequence
  Synthetically generated peptide
YIVPSGGATHYADSVKG

SEQ ID NO: 672 - protein, 19 aa, Artificial Sequence
  Synthetically generated peptide
ALRGYSYGPRGYYYYGMDV

SEQ ID NO: 673 - protein, 13 aa, Artificial Sequence
  Synthetically generated peptide
SPSGGGLRNKYVS

SEQ ID NO: 674 - protein, 7 aa, Artificial Sequence
  Synthetically generated peptide
KDAERPS

SEQ ID NO: 675 - protein, 9 aa, Artificial Sequence
  Synthetically generated peptide
LAWDSTTRV

SEQ ID NO: 676 - protein, 5 aa, Artificial Sequence
  Synthetically generated peptide
HYKMN

SEQ ID NO: 677 - protein, 17 aa, Artificial Sequence
  Synthetically generated peptide
YIGSSGGKTGYADSVKG

SEQ ID NO: 678 - protein, 128 aa, Artificial Sequence
  Synthetically generated peptide
EVQLLESGGGLVQPGGSLRLSCAASGFTFSHYPMDWVRQAPGKGLEWVSYIGPSGGSTRYADSVKGRFTISRDNSKNTLYLQMNSLRAEDTAVYYCARHVPPGTWGQGTLVTVSSASTKGPSVFPLAP

SEQ ID NO: 679 - protein, 11 aa, Artificial Sequence
  Synthetically generated peptide
RASQSISNWLA

SEQ ID NO: 680 - protein, 7 aa, Artificial Sequence
  Synthetically generated peptide
KASTLQT

SEQ ID NO: 681 - protein, 9 aa, Artificial Sequence
  Synthetically generated peptide
QQTYSAPFN

SEQ ID NO: 682 - protein, 5 aa, Artificial Sequence
  Synthetically generated peptide
NYNMH

SEQ ID NO: 683 - protein, 17 aa, Artificial Sequence
  Synthetically generated peptide
VIYPSGGYTVYADSVKG

SEQ ID NO: 684 - protein, 9 aa, Artificial Sequence
  Synthetically generated peptide
RGNWGGIDY

SEQ ID NO: 685 - protein, 11 aa, Artificial Sequence
  Synthetically generated peptide
RTSQTVSTFLN

SEQ ID NO: 686 - protein, 7 aa, Artificial Sequence
  Synthetically generated peptide
AASRLQS

SEQ ID NO: 687 - protein, 9 aa, Artificial Sequence
  Synthetically generated peptide
QQSFTSPRT

SEQ ID NO: 688 - protein, 5 aa, Artificial Sequence
  Synthetically generated peptide
RYVMH

SEQ ID NO: 689 - protein, 17 aa, Artificial Sequence
  Synthetically generated peptide
YISPSGGVTKYADSVKG

SEQ ID NO: 690 - protein, 14 aa, Artificial Sequence
  Synthetically generated peptide
ALYPGMGYYYGMDV

SEQ ID NO: 691 - protein, 12 aa, Artificial Sequence
  Synthetically generated peptide
RPSQSVYSNYLA

SEQ ID NO: 692 - protein, 7 aa, Artificial Sequence
  Synthetically generated peptide
GASTRAT

SEQ ID NO: 693 - protein, 8 aa, Artificial Sequence
  Synthetically generated peptide
QQYGNSYT

SEQ ID NO: 694 - protein, 5 aa, Artificial Sequence
  Synthetically generated peptide
HYNMT

SEQ ID NO: 695 - protein, 17 aa, Artificial Sequence
  Synthetically generated peptide
SIWPSGGATRYADSVKG

SEQ ID NO: 696 - protein, 9 aa, Artificial Sequence
  Synthetically generated peptide
TSRFYGMDV

SEQ ID NO: 697 - protein, 11 aa, Artificial Sequence
  Synthetically generated peptide
RASQSVNIDVG

SEQ ID NO: 698 - protein, 7 aa, Artificial Sequence
  Synthetically generated peptide
DASKRAT

SEQ ID NO: 699 - protein, 8 aa, Artificial Sequence
  Synthetically generated peptide
QQRARWLT

SEQ ID NO: 700 - protein, 5 aa, Artificial Sequence
  Synthetically generated peptide
NYFMN

SEQ ID NO: 701 - protein, 17 aa, Artificial Sequence
  Synthetically generated peptide
SIGSSGGYTRYADSVKG

SEQ ID NO: 702 - protein, 129 aa, Artificial Sequence
  Synthetically generated peptide
EVQLLESGGGLVQPGGSLRLSCAASGFTFSHYLMYWVRQAPGKGLEWVSWIGPSGGHTMYADSVKGRFTISRDNSKNTLYLQMNSLRAEDTAVYYCARLQQGLDYWGQGTLVTVSSASTKGPSVFPLAP

SEQ ID NO: 703 - protein, 11 aa, Artificial Sequence
  Synthetically generated peptide
RASQDIRTWLA

SEQ ID NO: 704 - protein, 7 aa, Artificial Sequence
  Synthetically generated peptide
SSSSLQS

SEQ ID NO: 705 - protein, 9 aa, Artificial Sequence
  Synthetically generated peptide
QQATTFPWT

SEQ ID NO: 706 - protein, 5 aa, Artificial Sequence
  Synthetically generated peptide
HYIMH

SEQ ID NO: 707 - protein, 17 aa, Artificial Sequence
  Synthetically generated peptide
GIYPSGGSTKYADSVKG

SEQ ID NO: 708 - protein, 8 aa, Artificial Sequence
  Synthetically generated peptide
ALVGALDY

SEQ ID NO: 709 - protein, 11 aa, Artificial Sequence
  Synthetically generated peptide
RASQGISNYLA

SEQ ID NO: 710 - protein, 7 aa, Artificial Sequence
  Synthetically generated peptide
AASTLQS

SEQ ID NO: 711 - protein, 9 aa, Artificial Sequence
  Synthetically generated peptide
EQLNSFPHA

SEQ ID NO: 712 - protein, 5 aa, Artificial Sequence
  Synthetically generated peptide
RYTME

SEQ ID NO: 713 - protein, 17 aa, Artificial Sequence
  Synthetically generated peptide
VIRPSGGTTMYADSVKG

SEQ ID NO: 714 - protein, 132 aa, Artificial Sequence
  Synthetically generated peptide
EVQLLESGGGLVQPGGSLRLSCAASGFTFSHYQMHWVRQAPGKGLEWVSRIRSSGGATSYADSVKGRFTISRDNSKNTLYLQMNSLRAEDTAVYYCARGGGYSYYFDYWGQGTLVTVSSASTKGPSVFPLAP

SEQ ID NO: 715 - protein, 11 aa, Artificial Sequence
  Synthetically generated peptide
RASQSVSRWLA

SEQ ID NO: 716 - protein, 7 aa, Artificial Sequence
  Synthetically generated peptide
KASTLES

SEQ ID NO: 717 - protein, 5 aa, Artificial Sequence
  Synthetically generated peptide
QQYGA

SEQ ID NO: 718 - protein, 5 aa, Artificial Sequence
  Synthetically generated peptide
HYTMQ

SEQ ID NO: 719 - protein, 17 aa, Artificial Sequence
  Synthetically generated peptide
SIYPSGGATKYADSVKG

SEQ ID NO: 720 - protein, 9 aa, Artificial Sequence
  Synthetically generated peptide
SGYYYGLDV

SEQ ID NO: 721 - protein, 137 aa, Artificial Sequence
  Synthetically generated peptide
EVQLLESGGGLVQPGGSLRLSCAASGFTFSWYTMTWVRQAPGKGLEWVSSIYPSGGHTSYADSVKGRFTISRDNSKNTLYLQMNSLRAEDTAVYYCAKDTRVGPWLVRAPLDYWGQGTLVTVSSASTKGPSVFPLAP

SEQ ID NO: 722 - protein, 145 aa, Artificial Sequence
  Synthetically generated peptide
EVQLLESGGGLVQPGGSLRLSCAASGFTFSKYKMVWVRQAPGKGLEWVSSIYPSGGITAYADSVKGRFTISRDNSKNTLYLQMNSLRAEDTAMYYCAKDITPGGGSGFRLPKNYYYYGMDVWGQGTTVTVSSASTKGPSVFPLAP

SEQ ID NO: 723 - protein, 5 aa, Artificial Sequence
  Synthetically generated peptide
QQRSN

SEQ ID NO: 724 - protein, 5 aa, Artificial Sequence
  Synthetically generated peptide
HYTMW

SEQ ID NO: 725 - protein, 17 aa, Artificial Sequence
  Synthetically generated peptide
RIWPSGGTTRYADSVKG

SEQ ID NO: 726 - protein, 9 aa, Artificial Sequence
  Synthetically generated peptide
GGSYLAFDI

SEQ ID NO: 727 - protein, 11 aa, Artificial Sequence
  Synthetically generated peptide
QGDSLRNYHPS

SEQ ID NO: 728 - protein, 8 aa, Artificial Sequence
  Synthetically generated peptide
FGRNNRPS

SEQ ID NO: 729 - protein, 10 aa, Artificial Sequence
  Synthetically generated peptide
SSRDGSGNFL

SEQ ID NO: 730 - protein, 5 aa, Artificial Sequence
  Synthetically generated peptide
NYTMM

SEQ ID NO: 731 - protein, 17 aa, Artificial Sequence
  Synthetically generated peptide
GIYPSGGQTAYADSVKG

SEQ ID NO: 732 - protein, 9 aa, Artificial Sequence
  Synthetically generated peptide
GGSWYAFDI

SEQ ID NO: 733 - protein, 11 aa, Artificial Sequence
  Synthetically generated peptide
RASQSISSFLN

SEQ ID NO: 734 - protein, 8 aa, Artificial Sequence
  Synthetically generated peptide
YAASSLQS

SEQ ID NO: 735 - protein, 9 aa, Artificial Sequence
  Synthetically generated peptide
QQSYSTPYT

SEQ ID NO: 736 - protein, 5 aa, Artificial Sequence
  Synthetically generated peptide
WYSMT

SEQ ID NO: 737 - protein, 17 aa, Artificial Sequence
  Synthetically generated peptide
SISPSGGATKYADSVKG

SEQ ID NO: 738 - protein, 10 aa, Artificial Sequence
  Synthetically generated peptide
GGAASLPFDY

SEQ ID NO: 739 - protein, 11 aa, Artificial Sequence
  Synthetically generated peptide
RASQSVGGYLA

SEQ ID NO: 740 - protein, 7 aa, Artificial Sequence
  Synthetically generated peptide
DASKRAT

SEQ ID NO: 741 - protein, 10 aa, Artificial Sequence
  Synthetically generated peptide
QQRSKWPPYT

SEQ ID NO: 742 - protein, 5 aa, Artificial Sequence
  Synthetically generated peptide
HYKMM

SEQ ID NO: 743 - protein, 17 aa, Artificial Sequence
  Synthetically generated peptide
YIYPSGGWTGYADSVKG

SEQ ID NO: 744 - protein, 9 aa, Artificial Sequence
  Synthetically generated peptide
VGPWDAFDI

SEQ ID NO: 745 - protein, 12 aa, Artificial Sequence
  Synthetically generated peptide
RASESVSSSYFA

SEQ ID NO: 746 - protein, 7 aa, Artificial Sequence
  Synthetically generated peptide
GASRRVT

SEQ ID NO: 747 - protein, 9 aa, Artificial Sequence
  Synthetically generated peptide
QQYGGSPRS

SEQ ID NO: 748 - protein, 5 aa, Artificial Sequence
  Synthetically generated peptide
RYMME

SEQ ID NO: 749 - protein, 17 aa, Artificial Sequence
  Synthetically generated peptide
GISPSGGTTKYADSVKG

SEQ ID NO: 750 - protein, 12 aa, Artificial Sequence
  Synthetically generated peptide
GGYNNYYYALDV

SEQ ID NO: 751 - protein, 14 aa, Artificial Sequence
  Synthetically generated peptide
TGTGSNIDGYNYVS

SEQ ID NO: 752 - protein, 7 aa, Artificial Sequence
  Synthetically generated peptide
DVGKRPS

SEQ ID NO: 753 - protein, 10 aa, Artificial Sequence
  Synthetically generated peptide
CSYAGSYSYV

SEQ ID NO: 754 - protein, 5 aa, Artificial Sequence
  Synthetically generated peptide
RYLMW

SEQ ID NO: 755 - protein, 17 aa, Artificial Sequence
  Synthetically generated peptide
VIGPSGGWTRYADSVKG

SEQ ID NO: 756 - protein, 5 aa, Artificial Sequence
  Synthetically generated peptide
HPGDY

SEQ ID NO: 757 - protein, 14 aa, Artificial Sequence
  Synthetically generated peptide
SGTSSDVGAYYHVS

SEQ ID NO: 758 - protein, 131 aa, Artificial Sequence
  Synthetically generated peptide
EVQLLESGGGLVQPGGSLRLSCAASGFTFSHYSMFWVRQAPGKGLEWVSSIYPSGGQTDYADSVKGRFTISRDNSKNTLYLQMNSLRAEDTAVYYCARRGLLWSFDSWGQGTLVTVSSASTKGPSVFPLAP

SEQ ID NO: 759 - protein, 11 aa, Artificial Sequence
  Synthetically generated peptide
SLYIGTSTPWV

SEQ ID NO: 760 - protein, 5 aa, Artificial Sequence
  Synthetically generated peptide
HYRMD

SEQ ID NO: 761 - protein, 17 aa, Artificial Sequence
  Synthetically generated peptide
GIYPSGGHTNYADSVKG

SEQ ID NO: 762 - protein, 9 aa, Artificial Sequence
  Synthetically generated peptide
DRGWYGADY

SEQ ID NO: 763 - protein, 14 aa, Artificial Sequence
  Synthetically generated peptide
TGTTRDVGAYKYVS

SEQ ID NO: 764 - protein, 7 aa, Artificial Sequence
  Synthetically generated peptide
DVSKRPS

SEQ ID NO: 765 - protein, 10 aa, Artificial Sequence
  Synthetically generated peptide
CSFAGSYTWI

SEQ ID NO: 766 - protein, 5 aa, Artificial Sequence
  Synthetically generated peptide
HYWMV

SEQ ID NO: 767 - protein, 17 aa, Artificial Sequence
  Synthetically generated peptide
WIGPSGGGTVYADSVKG

SEQ ID NO: 768 - protein, 140 aa, Artificial Sequence
  Synthetically generated peptide
EVQLLESGGGLVQPGGSLRLSCAASGFTFSRYFMIWVRQAPGKGLEWVSSIVPSGGPTRYADSVKGRFTISRDNSKNTLYLQMNSLRAEDTAVYYCARRGPVYYYDSSGSHSAFDIWGQGTMVTVSSASTKGPSVFPLAP

SEQ ID NO: 769 - protein, 13 aa, Artificial Sequence
  Synthetically generated peptide
SGSRSNIGTNPVN

SEQ ID NO: 770 - protein, 7 aa, Artificial Sequence
  Synthetically generated peptide
VNNQRPS

SEQ ID NO: 771 - protein, 11 aa, Artificial Sequence
  Synthetically generated peptide
ATWDGSLNGPV

SEQ ID NO: 772 - protein, 5 aa, Artificial Sequence
  Synthetically generated peptide
SYAMT

SEQ ID NO: 773 - protein, 17 aa, Artificial Sequence
  Synthetically generated peptide
SISSSGGDTAYADSVKG

SEQ ID NO: 774 - protein, 16 aa, Artificial Sequence
  Synthetically generated peptide
ERHYIWGSYRYSWFDP

SEQ ID NO: 775 - protein, 13 aa, Artificial Sequence
  Synthetically generated peptide
SGSSSNIGSNNVN

SEQ ID NO: 776 - protein, 7 aa, Artificial Sequence
  Synthetically generated peptide
SNDQRPS

SEQ ID NO: 777 - protein, 11 aa, Artificial Sequence
  Synthetically generated peptide
AAWDDSLNGPV

SEQ ID NO: 778 - protein, 5 aa, Artificial Sequence
  Synthetically generated peptide
HYLMV

SEQ ID NO: 779 - protein, 17 aa, Artificial Sequence
  Synthetically generated peptide
GIVPSGGYTMYADSVKG

SEQ ID NO: 780 - protein, 10 aa, Artificial Sequence
  Synthetically generated peptide
ASYSSFGLDY

SEQ ID NO: 781 - protein, 11 aa, Artificial Sequence
  Synthetically generated peptide
RASQSISSWLA

SEQ ID NO: 782 - protein, 7 aa, Artificial Sequence
  Synthetically generated peptide
KASSLES

SEQ ID NO: 783 - protein, 9 aa, Artificial Sequence
  Synthetically generated peptide
QQYNSYPVT

SEQ ID NO: 784 - protein, 5 aa, Artificial Sequence
  Synthetically generated peptide
FYPMS

SEQ ID NO: 785 - protein, 17 aa, Artificial Sequence
  Synthetically generated peptide
YIWPSGGATRYADSVKG

SEQ ID NO: 786 - protein, 131 aa, Artificial Sequence
  Synthetically generated peptide
EVQLLESGGGLVQPGGSLRLSCAASGFTFSHYLMDWVRQAPGKGLEWVSVIYPSGGHTNYADSVKGRFTISRDNSKNTLYLQMNSLRAEDTAVYYCARVGVWYGMDVWGQGTTVTVSSASTKGPSVFPLAP

SEQ ID NO: 787 - protein, 14 aa, Artificial Sequence
  Synthetically generated peptide
TGTSSDIGAYPFVS

SEQ ID NO: 788 - protein, 5 aa, Artificial Sequence
  Synthetically generated peptide
GVTWF

SEQ ID NO: 789 - protein, 12 aa, Artificial Sequence
  Synthetically generated peptide
SSYAGGRNLPYV

SEQ ID NO: 790 - protein, 5 aa, Artificial Sequence
  Synthetically generated peptide
HYYMA

SEQ ID NO: 791 - protein, 17 aa, Artificial Sequence
  Synthetically generated peptide
YISPSGGSTKYADSVKG

SEQ ID NO: 792 - protein, 9 aa, Artificial Sequence
  Synthetically generated peptide
GGGTGTFDI

SEQ ID NO: 793 - protein, 11 aa, Artificial Sequence
  Synthetically generated peptide
RASQSISRWLA

SEQ ID NO: 794 - protein, 7 aa, Artificial Sequence
  Synthetically generated peptide
EASTLES

SEQ ID NO: 795 - protein, 9 aa, Artificial Sequence
  Synthetically generated peptide
QQYNSYPLT

SEQ ID NO: 796 - protein, 5 aa, Artificial Sequence
  Synthetically generated peptide
HYPMH

SEQ ID NO: 797 - protein, 17 aa, Artificial Sequence
  Synthetically generated peptide
SIWPSGGHTSYADSVKG

SEQ ID NO: 798 - protein, 5 aa, Artificial Sequence
  Synthetically generated peptide
LSQPI

SEQ ID NO: 799 - protein, 11 aa, Artificial Sequence
  Synthetically generated peptide
RASQSVSNFLA

SEQ ID NO: 800 - protein, 5 aa, Artificial Sequence
  Synthetically generated peptide
GNRAT

SEQ ID NO: 801 - protein, 9 aa, Artificial Sequence
  Synthetically generated peptide
QQANSFPLT

SEQ ID NO: 802 - protein, 5 aa, Artificial Sequence
  Synthetically generated peptide
MYRMF

SEQ ID NO: 803 - protein, 17 aa, Artificial Sequence
  Synthetically generated peptide
VIGPSGGQTAYADSVKG

SEQ ID NO: 804 - protein, 133 aa, Artificial Sequence
  Synthetically generated peptide
EVQLLESGGGLVQPGGSLRLSCAASGFTFSNYSMQWVRQAPGKGLEWVSGIRPSGGSTRYADSVKGRFTISRDNSKNTLYLQMNSLRAEDTAVYYCAVSTGGYYYGMDVWGQGTTVTVSSASTKGPSVFPLAP

SEQ ID NO: 805 - protein, 14 aa, Artificial Sequence
  Synthetically generated peptide
TGTSGEVANYNYVS

SEQ ID NO: 806 - protein, 7 aa, Artificial Sequence
  Synthetically generated peptide
DVSRRPS

SEQ ID NO: 807 - protein, 10 aa, Artificial Sequence
  Synthetically generated peptide
ASYVGNDKLV

SEQ ID NO: 808 - protein, 5 aa, Artificial Sequence
  Synthetically generated peptide
HYGMN

SEQ ID NO: 809 - protein, 17 aa, Artificial Sequence
  Synthetically generated peptide
SIWSSGGYTTYADSVKG

SEQ ID NO: 810 - protein, 9 aa, Artificial Sequence
  Synthetically generated peptide
VGIWYSMDV

SEQ ID NO: 811 - protein, 11 aa, Artificial Sequence
  Synthetically generated peptide
RASQSINSYLN

SEQ ID NO: 812 - protein, 7 aa, Artificial Sequence
  Synthetically generated peptide
AASSLQN

SEQ ID NO: 813 - protein, 140 aa, Artificial Sequence
  Synthetically generated peptide
EVQLLESGGGLVQPGGSLRLSCAASGFTFSRYHMSWVRQAPGKGLEWVSSIRPSGGSTIYADSVKGRFTISRDNSKNTLYLQMNSLRAEDTAVYYCAREPRRYYYDSSGSYDAFDIWGQGTMVTVSSASTKGPSVFPLAP

SEQ ID NO: 814 - protein, 5 aa, Artificial Sequence
  Synthetically generated peptide
RYTMF

SEQ ID NO: 815 - protein, 17 aa, Artificial Sequence
  Synthetically generated peptide
GIYPSGGKTIYADSVKG

SEQ ID NO: 816 - protein, 9 aa, Artificial Sequence
  Synthetically generated peptide
GGVFGVVDY

SEQ ID NO: 817 - protein, 11 aa, Artificial Sequence
  Synthetically generated peptide
RASQGISNYLA

SEQ ID NO: 818 - protein, 7 aa, Artificial Sequence
  Synthetically generated peptide
AASTLQS

SEQ ID NO: 819 - protein, 9 aa, Artificial Sequence
  Synthetically generated peptide
QKYNSAPLT

SEQ ID NO: 820 - protein, 5 aa, Artificial Sequence
  Synthetically generated peptide
HYPMD

SEQ ID NO: 821 - protein, 17 aa, Artificial Sequence
  Synthetically generated peptide
RIYPSGGATKYADSVKG

SEQ ID NO: 822 - protein, 7 aa, Artificial Sequence
  Synthetically generated peptide
GGGAFDI

SEQ ID NO: 823 - protein, 135 aa, Artificial Sequence
  Synthetically generated peptide
EVQLLESGGGLVQPGGSLRLSCAASGFTFSWYRMSWVRQAPGKGLEWVSSISPSGGPTKYADSVKGRFTISRDNSKNTLYLQMNSLRAEDTAVYYCARPSGDSSVYRPFASWGQGTLVTVSSASTKGPSVFPLAP

SEQ ID NO: 824 - protein, 131 aa, Artificial Sequence
  Synthetically generated peptide
EVQLLESGGGLVQPGGSLRLSCAASGFTFSHYVMIWVRQAPGKGLEWVSWIYPSGGNTIYADSVKGRFTISRDNSKNTLYLQMNSLRAEDTATYYCARVGVWYGMDVWGQGTTVTVSSASTKGPSVFPLAP

SEQ ID NO: 825 - protein, 8 aa, Artificial Sequence
  Synthetically generated peptide
QQRSNWLT

SEQ ID NO: 826 - protein, 5 aa, Artificial Sequence
  Synthetically generated peptide
HYEMA

SEQ ID NO: 827 - protein, 18 aa, Artificial Sequence
  Synthetically generated peptide
SVIYPSGGATRYADSVKG

SEQ ID NO: 828 - protein, 9 aa, Artificial Sequence
  Synthetically generated peptide
VAQYYGMDV

SEQ ID NO: 829 - protein, 12 aa, Artificial Sequence
  Synthetically generated peptide
RASQSVSSNYLA

SEQ ID NO: 830 - protein, 145 aa, Artificial Sequence
  Synthetically generated peptide
EVQLLESGGGLVQPGGSLRLSCAASGFTFSSYIMIWVRQAPGKGLEWVSYIRPSGGYTKYADSVKGRFTISRDNSKNTLYLQMNSLRAEDTAVYYCARVINAGPGRGYYWRGYSYSDAFDIWGQGTMVTVSSASTKGPSVFPLAP

SEQ ID NO: 831 - protein, 5 aa, Artificial Sequence
  Synthetically generated peptide
QQRWT

SEQ ID NO: 832 - protein, 5 aa, Artificial Sequence
  Synthetically generated peptide
WYTMQ

SEQ ID NO: 833 - protein, 17 aa, Artificial Sequence
  Synthetically generated peptide
RIYSSGGGTYYADSVKG

SEQ ID NO: 834 - protein, 9 aa, Artificial Sequence
  Synthetically generated peptide
VGPWGAFDI

SEQ ID NO: 835 - protein, 14 aa, Artificial Sequence
  Synthetically generated peptide
TGTSSDVGGYNYVS

SEQ ID NO: 836 - protein, 137 aa, Artificial Sequence
  Synthetically generated peptide
EVQLLESGGGLVQPGGSLRLSCAASGFTFSPYKMGWVRQAPGKGLEWVSSIYPSGGVTTYADSVKGRFTISRDNSKNTLYLQMNSLRAEDTAVYYCTKNINLRYDILTGYFDIWGQGTTVTVSSASTKGPSVFPLAP

SEQ ID NO: 837 - protein, 10 aa, Artificial Sequence
  Synthetically generated peptide
SSYTSSSTWV

SEQ ID NO: 838 - protein, 5 aa, Artificial Sequence
  Synthetically generated peptide
HYVMV

SEQ ID NO: 839 - protein, 17 aa, Artificial Sequence
  Synthetically generated peptide
SIYPSGGMTVYADSVKG

SEQ ID NO: 840 - protein, 9 aa, Artificial Sequence
  Synthetically generated peptide
RGIANSFNI

SEQ ID NO: 841 - protein, 11 aa, Artificial Sequence
  Synthetically generated peptide
RASQSISRYLN

SEQ ID NO: 842 - protein, 5 aa, Artificial Sequence
  Synthetically generated peptide
ANLQS

SEQ ID NO: 843 - protein, 9 aa, Artificial Sequence
  Synthetically generated peptide
QQSYSTPWT

SEQ ID NO: 844 - protein, 5 aa, Artificial Sequence
  Synthetically generated peptide
KYYMV

SEQ ID NO: 845 - protein, 17 aa, Artificial Sequence
  Synthetically generated peptide
VIGPSGGWTTYADSVKG

SEQ ID NO: 846 - protein, 9 aa, Artificial Sequence
  Synthetically generated peptide
VDYSNYFDY

SEQ ID NO: 847 - protein, 141 aa, Artificial Sequence
  Synthetically generated peptide
EVQLLESGGGLVQPGGSLRLSCAASGFTFSPYNMAWVRQAPGKGLEWVSSIWPSGGRTRYADSVKGRFTISRDNSKNTLYLQMNSLRAEDTAVYYCAKGVRSSGLLERGRVYDAFDIWGQGTMVTVSSASTKGPSVFPLAP

SEQ ID NO: 848 - protein, 131 aa, Artificial Sequence
  Synthetically generated peptide
EVQLLESGGGLVQPGGSLRLSCAASGFTFSNYSMQWVRQAPGKGLEWVSSIGPSGGRTWYADSVKGRFTISRDNSKNTLYLQMNSLRAEDTAVYYCARVGVWYGMDVWGQGTTVTVSSASTKGPSVFPLAP

SEQ ID NO: 849 - protein, 9 aa, Artificial Sequence
  Synthetically generated peptide
QQSYSTPWT

SEQ ID NO: 850 - protein, 5 aa, Artificial Sequence
  Synthetically generated peptide
SYIMI

SEQ ID NO: 851 - protein, 17 aa, Artificial Sequence
  Synthetically generated peptide
YIRPSGGYTKYADSVKG

SEQ ID NO: 852 - protein, 23 aa, Artificial Sequence
  Synthetically generated peptide
VINAGPGRGYYWRGYSYSDAFDI

SEQ ID NO: 853 - protein, 11 aa, Artificial Sequence
  Synthetically generated peptide
RASQGIGTHLN

SEQ ID NO: 854 - protein, 7 aa, Artificial Sequence
  Synthetically generated peptide
AASGLQS

SEQ ID NO: 855 - protein, 9 aa, Artificial Sequence
  Synthetically generated peptide
QQSYSVPRT

SEQ ID NO: 856 - protein, 5 aa, Artificial Sequence
  Synthetically generated peptide
NYPMV

SEQ ID NO: 857 - protein, 17 aa, Artificial Sequence
  Synthetically generated peptide
VIGPSGGKTKYADSVKG

SEQ ID NO: 858 - protein, 131 aa, Artificial Sequence
  Synthetically generated peptide
EVQLLESGGGLVQPGGSLRLSCAASGFTFSHYKMGWVRQAPGKGLEWVSSIRPSGGATKYADSVKGRFTISRDNSKNTLYLQMNSLRAEDTAVYYCARVGIWDAFDIWGQGAMVTVSSASTKGPSVFPLAP

SEQ ID NO: 859 - protein, 131 aa, Artificial Sequence
  Synthetically generated peptide
EVQLLESGGGLVQPGGSLRLSCAASGFTFSYYRMTWVRQAPGKGLEWVSSIYPSGGYTIYADSVKGRFTISRDNSKNTLYLQMNSLRAEDTAVYYCARLGQWLALDHWGQGTLVTVSSASTKGPSVFPLAP

SEQ ID NO: 860 - protein, 142 aa, Artificial Sequence
  Synthetically generated peptide
EVQLLESGGGLVQPGGSLRLSCAASGFTFSRYSMTWVRQAPGKGLEWVSSIYPSGGKTTYADSVKGRFTISRDNSKNTLYLQMNSLRAEDTAVYYCASMVAPYYYDSSGYPPAEYFQHWGQGTLVTVSSASTKGPSVFPLAP

SEQ ID NO: 861 - protein, 10 aa, Artificial Sequence
  Synthetically generated peptide
NSYTTSATLV

SEQ ID NO: 862 - protein, 5 aa, Artificial Sequence
  Synthetically generated peptide
HYLMM

SEQ ID NO: 863 - protein, 17 aa, Artificial Sequence
  Synthetically generated peptide
SIRSSGGITRYADSVKG

SEQ ID NO: 864 - protein, 9 aa, Artificial Sequence
  Synthetically generated peptide
VGYYYGMDV

SEQ ID NO: 865 - protein, 11 aa, Artificial Sequence
  Synthetically generated peptide
RASQSITGYLN

SEQ ID NO: 866 - protein, 136 aa, Artificial Sequence
  Synthetically generated peptide
EVQLLESGGGLVQPGGSLRLSCAASGFTFSRYVMHWVRQAPGKGLEWVSYISPSGGVTKYADSVKGRFTISRDNSKNTLYLQMNSLRAEDTAVYYCAKALYPGMGYYYGMDVWGQGTTVTVSSASTKGPSVFPLAP

SEQ ID NO: 867 - protein, 9 aa, Artificial Sequence
  Synthetically generated peptide
QQSYSTPYT

SEQ ID NO: 868 - protein, 5 aa, Artificial Sequence
  Synthetically generated peptide
NYPMY

SEQ ID NO: 869 - protein, 17 aa, Artificial Sequence
  Synthetically generated peptide
RIGPSGGHTDYADSVKG

SEQ ID NO: 870 - protein, 9 aa, Artificial Sequence
  Synthetically generated peptide
AGVWSGLDY

SEQ ID NO: 871 - protein, 11 aa, Artificial Sequence
  Synthetically generated peptide
RASQGISNYLA

SEQ ID NO: 872 - protein, 7 aa, Artificial Sequence
  Synthetically generated peptide
AASTLQS

SEQ ID NO: 873 - protein, 9 aa, Artificial Sequence
  Synthetically generated peptide
QKYNSAPWT

SEQ ID NO: 874 - protein, 5 aa, Artificial Sequence
  Synthetically generated peptide
HYLMG

SEQ ID NO: 875 - protein, 17 aa, Artificial Sequence
  Synthetically generated peptide
VIWPSGGITKYADSVKG

SEQ ID NO: 876 - protein, 130 aa, Artificial Sequence
  Synthetically generated peptide
EVQLLESGGGLVQPGGSLRLSCAASGFTFSFYLMFWVRQAPGKGLEWVSGIYPSGGQTVYADSVKGRFTISRDNSKNTLYLQMNSLRAEDTAVYYCARAIGAGSSFWGQGTLVTVSSASTKGPSVFPLAP

SEQ ID NO: 877 - protein, 14 aa, Artificial Sequence
  Synthetically generated peptide
TGTNTDVGGYNFVS

SEQ ID NO: 878 - protein, 7 aa, Artificial Sequence
  Synthetically generated peptide
DVTNRPS

SEQ ID NO: 879 - protein, 10 aa, Artificial Sequence
  Synthetically generated peptide
SSYTSSSTWV

SEQ ID NO: 880 - protein, 5 aa, Artificial Sequence
  Synthetically generated peptide
HYSML

SEQ ID NO: 881 - protein, 17 aa, Artificial Sequence
  Synthetically generated peptide
SIRPSGGFTKYADSVKG

SEQ ID NO: 882 - protein, 9 aa, Artificial Sequence
  Synthetically generated peptide
RGVWDAFDI

SEQ ID NO: 883 - protein, 137 aa, Artificial Sequence
  Synthetically generated peptide
EVQLLESGGGLVQPGGSLRLSCAASGFTFSPYTMSWVRQAPGKGLEWVSGIYPSGGETWYADSVKGRFTISRDNSKNTLYLQMNSLRAEDTAVYYCAKNINLRYDILTGYFDFWGQGTMVTVSSASTKGPSVFPLAP

SEQ ID NO: 884 - protein, 133 aa, Artificial Sequence
  Synthetically generated peptide
EVQLLESGGGLVQPGGSLRLSCAASGFTFSHYSMTWVRQAPGKGLEWVSRIYPSGGRTGYADSVKGRFTISRDNSKNTLYLQMNSLRAEDTAVYYCATDSGGYYYGMDVWGQGTTVTVSSASTKGPSVFPLAP

SEQ ID NO: 885 - protein, 9 aa, Artificial Sequence
  Synthetically generated peptide
QQSYSTPRT

SEQ ID NO: 886 - protein, 5 aa, Artificial Sequence
  Synthetically generated peptide
RYAMG

SEQ ID NO: 887 - protein, 17 aa, Artificial Sequence
  Synthetically generated peptide
YIGPSGGNTTYADSVKG

SEQ ID NO: 888 - protein, 20 aa, Artificial Sequence
  Synthetically generated peptide
DVGGSGSYYMLSYYYYGMDV

SEQ ID NO: 889 - protein, 12 aa, Artificial Sequence
  Synthetically generated peptide
RASQSVSSSYLA

SEQ ID NO: 890 - protein, 7 aa, Artificial Sequence
  Synthetically generated peptide
AASTRAT

SEQ ID NO: 891 - protein, 9 aa, Artificial Sequence
  Synthetically generated peptide
QQSYSTPWT

SEQ ID NO: 892 - protein, 5 aa, Artificial Sequence
  Synthetically generated peptide
RYPMG

SEQ ID NO: 893 - protein, 17 aa, Artificial Sequence
  Synthetically generated peptide
SIYPSGGSTYYADSVKG

SEQ ID NO: 894 - protein, 139 aa, Artificial Sequence
  Synthetically generated peptide
EVQLLESGGGLVQPGGSLRLSCAASGFTFSHYHMQWVRQAPGKGLEWVSGIRSSGGVTGYSDSVKGRFTISRDNSKNTLYLQMNSLRAEDTAVYYCAREVTMVRGVYYYYYGMDVWGQGTTVTVSSASTKGPSVFPLAP

SEQ ID NO: 895 - protein, 11 aa, Artificial Sequence
  Synthetically generated peptide
SGDDLGGRHVS

SEQ ID NO: 896 - protein, 7 aa, Artificial Sequence
  Synthetically generated peptide
QDDKRPS

SEQ ID NO: 897 - protein, 9 aa, Artificial Sequence
  Synthetically generated peptide
LAWHNYKYV

SEQ ID NO: 898 - protein, 5 aa, Artificial Sequence
  Synthetically generated peptide
NYLMG

SEQ ID NO: 899 - protein, 17 aa, Artificial Sequence
  Synthetically generated peptide
SIGPSGGYTKYADSVKG

SEQ ID NO: 900 - protein, 7 aa, Artificial Sequence
  Synthetically generated peptide
GTGTTFF

SEQ ID NO: 901 - protein, 140 aa, Artificial Sequence
  Synthetically generated peptide
EVQLLESGGGLVQPGGSLRLSCAASGFTFSPYRMSWVRQAPGKGLEWVSVISPSGGITEYADSVKGRFTISRDNSKNTLYLQMNSLRAEDTAVYYCAKHERGSGYYVTPPAGAFDIWGQGTMVTVSSASTKGPSVFPLAP

SEQ ID NO: 902 - protein, 131 aa, Artificial Sequence
  Synthetically generated peptide
EVQLLESGGGLVQPGGSLRLSCAASGFTFSHYMMHWVRQAPGKGLEWVSGIGPSGGKTPYADSVKGRFTISRDNSKNTLYLQMNSLRAEDTAVYYCARVGVWYGMDVWGQGTTVTVSSASTKGPSVFPLAP

SEQ ID NO: 903 - protein, 9 aa, Artificial Sequence
  Synthetically generated peptide
QQSYSTLVT

SEQ ID NO: 904 - protein, 5 aa, Artificial Sequence
  Synthetically generated peptide
HYMMQ

SEQ ID NO: 905 - protein, 17 aa, Artificial Sequence
  Synthetically generated peptide
GIGPSGGWTKYADSVKG

SEQ ID NO: 906 - protein, 7 aa, Artificial Sequence
  Synthetically generated peptide
LNYGDYV

SEQ ID NO: 907 - protein, 11 aa, Artificial Sequence
  Synthetically generated peptide
RASQGISSSLA

SEQ ID NO: 908 - protein, 7 aa, Artificial Sequence
  Synthetically generated peptide
AASTLQS

SEQ ID NO: 909 - protein, 9 aa, Artificial Sequence
  Synthetically generated peptide
QQSYSTPWT

SEQ ID NO: 910 - protein, 5 aa, Artificial Sequence
  Synthetically generated peptide
HYLMH

SEQ ID NO: 911 - protein, 17 aa, Artificial Sequence
  Synthetically generated peptide
SIYPSGGKTQYADSVKG

SEQ ID NO: 912 - protein, 17 aa, Artificial Sequence
  Synthetically generated peptide
VFGYYDFWSGYPGAFDY

SEQ ID NO: 913 - protein, 11 aa, Artificial Sequence
  Synthetically generated peptide
GGNNIGSKNVH

SEQ ID NO: 914 - protein, 7 aa, Artificial Sequence
  Synthetically generated peptide
RDSNRPS

SEQ ID NO: 915 - protein, 8 aa, Artificial Sequence
  Synthetically generated peptide
QVWDSSTV

SEQ ID NO: 916 - protein, 5 aa, Artificial Sequence
  Synthetically generated peptide
HYVMV

SEQ ID NO: 917 - protein, 17 aa, Artificial Sequence
  Synthetically generated peptide
GIRSSGGVTAYADSVKG

SEQ ID NO: 918 - protein, 133 aa, Artificial Sequence
  Synthetically generated peptide
EVQLLESGGGLVQPGGSLRLSCAASGFTFSWYVMRWVRQAPGKGLEWVSSIYPSGGQTRYADSVKGRFTISRDNSKNTLYLQMNSLRAEDTAMYYCATGYSSTWGAFDIWGQGTMVTVSSASTKGPSVFPLAP

SEQ ID NO: 919 - protein, 12 aa, Artificial Sequence
  Synthetically generated peptide
RASQTVSSTYLA

SEQ ID NO: 920 - protein, 137 aa, Artificial Sequence
  Synthetically generated peptide
EVQLLESGGGLVQPGGSLRLSCAASGFTFSWYTMTWVRQAPGKGLEWVSSIYPSGGHTSYADSVKGRFTISRDNSKNTFYLQMNSLRAEDTAVYYCAKDTRVGPWLVRAPLDYWGQGTLVTVSSASTKGPSVFPLAP

SEQ ID NO: 921 - protein, 11 aa, Artificial Sequence
  Synthetically generated peptide
QQYGSSPPRYT

SEQ ID NO: 922 - protein, 5 aa, Artificial Sequence
  Synthetically generated peptide
RYRMV

SEQ ID NO: 923 - protein, 17 aa, Artificial Sequence
  Synthetically generated peptide
SIYPSGGYTKYADSVKG

SEQ ID NO: 924 - protein, 9 aa, Artificial Sequence
  Synthetically generated peptide
VITYNNFDS

SEQ ID NO: 925 - protein, 11 aa, Artificial Sequence
  Synthetically generated peptide
RASLSVSGYLN

SEQ ID NO: 926 - protein, 7 aa, Artificial Sequence
  Synthetically generated peptide
ATSSLQS

SEQ ID NO: 927 - protein, 9 aa, Artificial Sequence
  Synthetically generated peptide
QQSYSSPYT

SEQ ID NO: 928 - protein, 5 aa, Artificial Sequence
  Synthetically generated peptide
HYAMF

SEQ ID NO: 929 - protein, 17 aa, Artificial Sequence
  Synthetically generated peptide
SIWPSGGKTMYADSVKG

SEQ ID NO: 930 - protein, 9 aa, Artificial Sequence
  Synthetically generated peptide
GGSYLAFDI

SEQ ID NO: 931 - protein, 11 aa, Artificial Sequence
  Synthetically generated peptide
LASQSISSYLN

SEQ ID NO: 932 - protein, 7 aa, Artificial Sequence
  Synthetically generated peptide
DASSLES

SEQ ID NO: 933 - protein, 10 aa, Artificial Sequence
  Synthetically generated peptide
QQFNGYPPIT

SEQ ID NO: 934 - protein, 5 aa, Artificial Sequence
  Synthetically generated peptide
RYPMI

SEQ ID NO: 935 - protein, 17 aa, Artificial Sequence
  Synthetically generated peptide
VIYPSGGMTKYADSVKG

SEQ ID NO: 936 - protein, 9 aa, Artificial Sequence
  Synthetically generated peptide
VGSYGSLGY

SEQ ID NO: 937 - protein, 12 aa, Artificial Sequence
  Synthetically generated peptide
GASQSVSTTYIA

SEQ ID NO: 938 - protein, 5 aa, Artificial Sequence
  Synthetically generated peptide
GNRAT

SEQ ID NO: 939 - protein, 9 aa, Artificial Sequence
  Synthetically generated peptide
QQYGSSPYT

SEQ ID NO: 940 - protein, 5 aa, Artificial Sequence
  Synthetically generated peptide
RYWMW

SEQ ID NO: 941 - protein, 17 aa, Artificial Sequence
  Synthetically generated peptide
SIGPSGGATRYADSVKG

SEQ ID NO: 942 - protein, 5 aa, Artificial Sequence
  Synthetically generated peptide
GSAGN

SEQ ID NO: 943 - protein, 11 aa, Artificial Sequence
  Synthetically generated peptide
RASQSIDTYLN

SEQ ID NO: 944 - protein, 7 aa, Artificial Sequence
  Synthetically generated peptide
AASKLED

SEQ ID NO: 945 - protein, 9 aa, Artificial Sequence
  Synthetically generated peptide
QPYNTYPIT

SEQ ID NO: 946 - protein, 5 aa, Artificial Sequence
  Synthetically generated peptide
HYGMY

SEQ ID NO: 947 - protein, 17 aa, Artificial Sequence
  Synthetically generated peptide
SIYPSGGWTNYADSVKG

SEQ ID NO: 948 - protein, 9 aa, Artificial Sequence
  Synthetically generated peptide
RGSWGAFDI

SEQ ID NO: 949 - protein, 12 aa, Artificial Sequence
  Synthetically generated peptide
RASQSVSNSYLA

SEQ ID NO: 950 - protein, 138 aa, Artificial Sequence
  Synthetically generated peptide
EVQLLESGGGLVQPGGSLRLSCAASGFTFSHYPMTWVRQAPGKGLEWVSSIRPSGGNTGYADSVKGRFTISRDNSKNTLYLQMNSLRAEDTAVYYCARLTGYSSGWFWAYGMDVWGQGTTVTVSSASTKGPSVFPLAP

SEQ ID NO: 951 - protein, 10 aa, Artificial Sequence
  Synthetically generated peptide
QQFGSSTGYT

SEQ ID NO: 952 - protein, 5 aa, Artificial Sequence
  Synthetically generated peptide
YYMMG

SEQ ID NO: 953 - protein, 17 aa, Artificial Sequence
  Synthetically generated peptide
SIYTSGGYTKYADSVKG

SEQ ID NO: 954 - protein, 9 aa, Artificial Sequence
  Synthetically generated peptide
ASIYYGMDV

SEQ ID NO: 955 - protein, 128 aa, Artificial Sequence
  Synthetically generated peptide
EVQLLESGGGLVQPGGSLRLSCAASGFTFSWYFMVWVRQAPGKGLEWVSGIGPSGGLTTYADSVKGRFTISRDNSKNTLYLQMNSLRAEDTAVYYCARSDWLNYWGQGTLVTVSSASTKGPSVFPLAP

SEQ ID NO: 956 - protein, 7 aa, Artificial Sequence
  Synthetically generated peptide
AASSLQS

SEQ ID NO: 957 - protein, 9 aa, Artificial Sequence
  Synthetically generated peptide
QQANSFPYT

SEQ ID NO: 958 - protein, 5 aa, Artificial Sequence
  Synthetically generated peptide
YYLMG

SEQ ID NO: 959 - protein, 17 aa, Artificial Sequence
  Synthetically generated peptide
SIGPSGGTTKYADSVKG

SEQ ID NO: 960 - protein, 9 aa, Artificial Sequence
  Synthetically generated peptide
RGLGAAFDY

SEQ ID NO: 961 - protein, 12 aa, Artificial Sequence
  Synthetically generated peptide
RASQSVSSSYLA

SEQ ID NO: 962 - protein, 145 aa, Artificial Sequence
  Synthetically generated peptide
EVQLLESGGGLVQPGGSLRLSCAASGFTFSYYKMHWVRQAPGKGLEWVSVIYPSGGKTTYADSVKGRFTISRDNSKNTLYLQMNSLRAEDTAVYYCTREHYQASYSSSAWFRMVPAGAFDIWGQGTMVTVSSASTKGPSVFPLAP

SEQ ID NO: 963 - protein, 9 aa, Artificial Sequence
  Synthetically generated peptide
QQYGSSSFT

SEQ ID NO: 964 - protein, 5 aa, Artificial Sequence
  Synthetically generated peptide
HYIMM

SEQ ID NO: 965 - protein, 17 aa, Artificial Sequence
  Synthetically generated peptide
SIYPSGGSTIYADSVKG

SEQ ID NO: 966 - protein, 11 aa, Artificial Sequence
  Synthetically generated peptide
ATEGYYYGMDV

SEQ ID NO: 967 - protein, 11 aa, Artificial Sequence
  Synthetically generated peptide
RASQGIRSWLA

SEQ ID NO: 968 - protein, 138 aa, Artificial Sequence
  Synthetically generated peptide
EVQLLESGGGLVQPGGSLRLSCAASGFTFSWYSMNWVRQAPGKGLEWVSSIGPSGGGTKYADSVKGRFTISRDNSKNTLYLQMNSLRAEDTAVYYCASRGQRKQWLPPNGAFDIWGQGTMVTVSSASTKGPSVFPLAP

SEQ ID NO: 969 - protein, 9 aa, Artificial Sequence
  Synthetically generated peptide
QQSYSTPWT

SEQ ID NO: 970 - protein, 5 aa, Artificial Sequence
  Synthetically generated peptide
WYRMA

SEQ ID NO: 971 - protein, 17 aa, Artificial Sequence
  Synthetically generated peptide
YIGPSGGSTSYADSVKG

SEQ ID NO: 972 - protein, 9 aa, Artificial Sequence
  Synthetically generated peptide
VGTFYGMDV

SEQ ID NO: 973 - protein, 11 aa, Artificial Sequence
  Synthetically generated peptide
RASQTISSYLN

SEQ ID NO: 974 - protein, 7 aa, Artificial Sequence
  Synthetically generated peptide
AASSLQS

SEQ ID NO: 975 - protein, 10 aa, Artificial Sequence
  Synthetically generated peptide
QQSYSTPMYT

SEQ ID NO: 976 - protein, 5 aa, Artificial Sequence
  Synthetically generated peptide
WYLMG

SEQ ID NO: 977 - protein, 17 aa, Artificial Sequence
  Synthetically generated peptide
VIGPSGGLTKYADSVKG

SEQ ID NO: 978 - protein, 9 aa, Artificial Sequence
  Synthetically generated peptide
FRGYYGMDV

SEQ ID NO: 979 - protein, 11 aa, Artificial Sequence
  Synthetically generated peptide
RASQSVRKNVA

SEQ ID NO: 980 - protein, 7 aa, Artificial Sequence
  Synthetically generated peptide
GASTRAT

SEQ ID NO: 981 - protein, 8 aa, Artificial Sequence
  Synthetically generated peptide
QQYSSWPA

SEQ ID NO: 982 - protein, 5 aa, Artificial Sequence
  Synthetically generated peptide
NYLMY

SEQ ID NO: 983 - protein, 17 aa, Artificial Sequence
  Synthetically generated peptide
SIRPSGGNTLYADSVKG

SEQ ID NO: 984 - protein, 18 aa, Artificial Sequence
  Synthetically generated peptide
GRGILTGYYWGYYYYMDV

SEQ ID NO: 985 - protein, 12 aa, Artificial Sequence
  Synthetically generated peptide
RASQSISSSYLA

SEQ ID NO: 986 - protein, 7 aa, Artificial Sequence
  Synthetically generated peptide
HASSRAT

SEQ ID NO: 987 - protein, 11 aa, Artificial Sequence
  Synthetically generated peptide
QQRNNWPPSFT

SEQ ID NO: 988 - protein, 5 aa, Artificial Sequence
  Synthetically generated peptide
LYLME

SEQ ID NO: 989 - protein, 17 aa, Artificial Sequence
  Synthetically generated peptide
SIGSSGGATWYADSVKG

SEQ ID NO: 990 - protein, 21 aa, Artificial Sequence
  Synthetically generated peptide
DTSRVAGTRLRNYYYYYGMDV

SEQ ID NO: 991 - protein, 11 aa, Artificial Sequence
  Synthetically generated peptide
RASQSIGTLLN

SEQ ID NO: 992 - protein, 5 aa, Artificial Sequence
  Synthetically generated peptide
GNLRG

SEQ ID NO: 993 - protein, 4 aa, Artificial Sequence
  Synthetically generated peptide
QHDT

SEQ ID NO: 994 - protein, 5 aa, Artificial Sequence
  Synthetically generated peptide
WYRMH

SEQ ID NO: 995 - protein, 17 aa, Artificial Sequence
  Synthetically generated peptide
SIWPSGGKTHYADSVKG

SEQ ID NO: 996 - protein, 23 aa, Artificial Sequence
  Synthetically generated peptide
ALQYGSGSYFYAPKSYYYYGMDV

SEQ ID NO: 997 - protein, 11 aa, Artificial Sequence
  Synthetically generated peptide
RASQTISRYLN

SEQ ID NO: 998 - protein, 131 aa, Artificial Sequence
  Synthetically generated peptide
EVQLLESGGGLVQPGGSLRLSCAASGFTFSHYLMFWVRQAPGKGLEWVSSIWPSGGNTKYADSVKGRFTISRDNSKNTLYLQMNSLRAEDTAVYYCARPAYYYAMDVWGQGTTVTVSSASTKGPSVFPLAP

SEQ ID NO: 999 - protein, 9 aa, Artificial Sequence
  Synthetically generated peptide
QQSYSAPRT

SEQ ID NO: 1000 - protein, 5 aa, Artificial Sequence
  Synthetically generated peptide
KYKMG

SEQ ID NO: 1001 - protein, 17 aa, Artificial Sequence
  Synthetically generated peptide
YIRPSGGMTFYADSVKG

SEQ ID NO: 1002 - protein, 23 aa, Artificial Sequence
  Synthetically generated peptide
EHYQASYSSSAWFRMVPAGAFDI

SEQ ID NO: 1003 - protein, 9 aa, Artificial Sequence
  Synthetically generated peptide
RASQGIRRA

SEQ ID NO: 1004 - protein, 7 aa, Artificial Sequence
  Synthetically generated peptide
DASSLES

SEQ ID NO: 1005 - protein, 10 aa, Artificial Sequence
  Synthetically generated peptide
QQSYSTPPWT

SEQ ID NO: 1006 - protein, 5 aa, Artificial Sequence
  Synthetically generated peptide
YYKMH

SEQ ID NO: 1007 - protein, 17 aa, Artificial Sequence
  Synthetically generated peptide
VIYPSGGKTTYADSVKG

SEQ ID NO: 1008 - protein, 138 aa, Artificial Sequence
  Synthetically generated peptide
EVQLLESGGGLVQPGGSLRLSCAASGFTFSMYVMNWVRQAPGKGLEWVSRIGSSGGGTLYADSVKGRFTISRDNSKNTLYLQMNSLRAEDTAVYYCARVSVYRIRNYYYYAMDVWGQGTTVTVSSASTKGPSVFPLAP

SEQ ID NO: 1009 - protein, 12 aa, Artificial Sequence
  Synthetically generated peptide
RASQSVVSNFLA

SEQ ID NO: 1010 - protein, 129 aa, Artificial Sequence
  Synthetically generated peptide
EVQLLESGGGLVQPGGSLRLSCAASGFTFSHYPMDWVRQAPGKGLEWVSRIYPSGGATKYADSVKGRFTISRDNSKNTLYLQMNSLRAEDTATYYCARGGGAFDIWGQGTMVTVSSASTKGPSVFPLAP

SEQ ID NO: 1011 - protein, 9 aa, Artificial Sequence
  Synthetically generated peptide
QQYGSSPYS

SEQ ID NO: 1012 - protein, 5 aa, Artificial Sequence
  Synthetically generated peptide
NYVMY

SEQ ID NO: 1013 - protein, 17 aa, Artificial Sequence
  Synthetically generated peptide
GIGPSGGFTTYADSVKG

SEQ ID NO: 1014 - protein, 20 aa, Artificial Sequence
  Synthetically generated peptide
DRYFGSGYYMAAYYYYGMDV

SEQ ID NO: 1015 - protein, 12 aa, Artificial Sequence
  Synthetically generated peptide
RASQRVSSTFLA

SEQ ID NO: 1016 - protein, 7 aa, Artificial Sequence
  Synthetically generated peptide
GTSSRAT

SEQ ID NO: 1017 - protein, 9 aa, Artificial Sequence
  Synthetically generated peptide
HQYGSSPRT

SEQ ID NO: 1018 - protein, 5 aa, Artificial Sequence
  Synthetically generated peptide
WYAMM

SEQ ID NO: 1019 - protein, 17 aa, Artificial Sequence
  Synthetically generated peptide
SIWPSGGHTKYADSVKG

SEQ ID NO: 1020 - protein, 5 aa, Artificial Sequence
  Synthetically generated peptide
DQGYF

SEQ ID NO: 1021 - protein, 262 aa, Homo sapiens [sequence omitted]

SEQ ID NO: 1022 - protein, 115 aa, Homo sapiens
AQDIQMTQSPSSLSASVGDRVTITCRASQGISNYLAWYQQKPGKVPKLLIYAASTLQSGVPSRFSGSGSGTDFTLTISSLQPEDFATYYCQQSYSTPYTFGQGTKLEVRRTVAAP

SEQ ID NO: 1023 - protein, 116 aa, Homo sapiens
AQDIQMTQSPATLSLSPGERATLSCGASQSVSSSYLAWYQQKPGLAPRLLIYDASSRATGIPDRFSGSGSGTDFTLTISSLQPEDFATYYCLHDYNFPFTFGPGTKVDIKRTVAAP

SEQ ID NO: 1024 - protein, 118 aa, Homo sapiens
AQSELTQPRSVSGSPGQSVTISCTGTSGEVANYNYVSWYHQDPGLVPKLKIYDVSRRPSGVPDRFSGAKSGDTASLTISGLQAEDEGDYYCASYVGNDKLVFGGGTKLTVLGQPKAAP

SEQ ID NO: 1025 - protein, 114 aa, Homo sapiens
AQDIQMTQSPGTLSLSPGDRATLSCRASQSVGSDYLAWYQQKPGQAPRLLIFAASTRATGIPDRFSGSGSATDFTLTISSLEPEDFAVYFCQQYDPRTFGQGTKVEIKRTVAAP

SEQ ID NO: 1026 - protein, 118 aa, Homo sapiens
AQDIQMTQSPGTLSLSPGERATLSCRASQSVSSSYLAWYQQKPGQAPRLLIFAASTRATGIPDRFSGSGSATDFTLTISSLEPEDFAVYYCQQRSNWPPELTFSGGTKVEIKRTVAAP

SEQ ID NO: 1027 - protein, 115 aa, Homo sapiens
AQDIQITQSPSSLSASVGDRVTITCRASQGISNYLAWYQQKPGKVPKLLIYAASTLQSGVPSRFSGSGSGTDFTLTISSLQPEDFATYYCEQLNSFPHAFGQGTKVEIKRTVAAP

SEQ ID NO: 1028 - protein, 112 aa, Homo sapiens
AQDIQMTQSPATLSLSPGERATLSCRASQSVSSYLAWYQQKPGQAPRLLIYDNRATGIPARFSGSGSGTDFTLTISSLEPEDFAVYYCQQRSNWLTFGGGTKVEIKRTVAAP

SEQ ID NO: 1029 - protein, 119 aa, Homo sapiens
AQSALTQPASVSGSPGQSITISCTGTSTDDVGGYNYVSWYQQHPGKAPKLMIYDVINRPSGVSNRFSGSKSGNTASLTISGLQAEDEADYYCSSYTSRGTRVFGTGTKVTVLGQPKANP

SEQ ID NO: 1030 - protein, 118 aa, Homo sapiens
AQSALTQPRSVSGSLGQSVTISCTGSTSDVGGYTYVSWYQQEPGKAPKLMIHDVSKRPSGVPDRFSGSKSGNTASLIISGLQAEDEADYYCCSYAGSYSYVFGTGTKVTVLGQPKANP

SEQ ID NO: 1031 - protein, 116 aa, Homo sapiens
AQDIQMTQSPSSLSASVGDRVTITCRASQSISSFLNWYQQKPGKAPKLLLMYAASSLQSGVPSRFSGSGSGTDFTLTISSLQPEDFATYYCQQSYSTPYTFGQGTKLEIKRTVAAP

SEQ ID NO: 1032 - protein, 118 aa, Homo sapiens
AQSALTQPPSASGTPGQRVTISCSGSSSNIGSNNVNWYQQLPGTAPKLLIYSNDQRPSGVPDRFSGSKSATSASLAISGLQSEDEADYHCAAWDDSLNGPVFGGGTKLTVLGQPKAAP

SEQ ID NO: 1033 - protein, 118 aa, Homo sapiens
AQSVLTQPASVSGSPGQSITISCTGTSSDVGAYNYVSWYQQHPGKVPELMIYDVSNRPSGVSHRFSGSKSGNTASLTISGLQAEDDADYYCSSFTSRKTWVFGTGTKVTVLGQPKANP

SEQ ID NO: 1034 - protein, 112 aa, Homo sapiens
AQDIQMTQSPGTLSLSLGETATLSCRASQTVGGSYLAWYRQKPGQAPSLLIYANRAPGIPDRFSGSGSGTDFTLTISSLQSEDFAVYYCQQYGSSMYTFGQGTIIKRTVAAP

SEQ ID NO: 1035 - protein, 114 aa, Homo sapiens
AQDIQMTQSPATLSLSPGERATLSCRASQSVSSYLAWYQQKPGQAPRLLIYDNRATGIPARFSGSGSGTDFTLTISSLEPEDFAVYYCQQRSNWPPYTFGQGTKLEIKRTVAAP

SEQ ID NO: 1036 - protein, 115 aa, Homo sapiens
AQDIQMTQSPSSLSASVGDRVTITCRASQSISNWLAWYQQKPGKAPKLLIYKASTLQTGVPSRFSGSGSGTEFSLTISSLQPDDFATYYCQQTYSAPFNFGPGTKVDIKRTVAAP

SEQ ID NO: 1037 - protein, 115 aa, Homo sapiens
AQDIQMTQSPSTLSASVGDRVTITCRASQSISSWLAWYQQKPGKAPKLLIYTASSLESGVPSRFSAGGSGTEFTLTISSLQPDDFGTYYCQQYNSYSLTFGGGTKVEIKRTVAAP

SEQ ID NO: 1038 - protein, 118 aa, Homo sapiens
AQSELTQPRSVSGSPGQSVTISCTGTTRDVGAYKYVSWYQQYPGKAPKLMLSDVSKRPSGVPDRFSGSKSGNTASLTISGLQSEDEADYYCCSFAGSYTWIFGGGTKVTVLGQPKAAP

SEQ ID NO: 1039 - protein, 118 aa, Homo sapiens
AQSALTQPPSASGTPGQRVTISCSGSSSNIGTNRVNWYQQIPGTAPKLLIYSNNQRPSGVPDRFSDSKSGTSASLAISGLQSEDEADYYCAAWDDSLNGVVFGGGTKLTVLGQPKAAP

SEQ ID NO: 1040 - protein, 114 aa, Homo sapiens
AQDIQMTQSPLSLSASVGDRVTMTCRASQTISSYLNWYQQKPGKAPKLLIYTTSSLQSGVPSRFSGSGSGTEFTLTISSLQPEDFATYYCQQSHSSPTFGGGTKVEIKRTVAAP

SEQ ID NO: 1041 - protein, 118 aa, Homo sapiens
AQSELTQPPSASGTPGQRVTISCSGSSSNIGSNYVYWYQQLPGMAPKLLIYRNNQRPSGVPDRFSGSKSGTSASLAISGLRSEDEADYYCAAWDDSMSGVVFGGGTKLTVLSQPKAAP

SEQ ID NO: 1042 - protein, 113 aa, Homo sapiens
AQDIQMTQSPSSLSASVGDRVTITCRASQSISSYLSWFQQRPGKAPKLLIYSNLQSGVPLRFSGSGSGTDFTLTISSLQPEDFATYYCQQIYRTPLTFGGGTKVEIKRTVAAP

SEQ ID NO: 1043 - protein, 114 aa, Homo sapiens
AQDIQMTQSPATLSVSPGGRATLSCRASQSVRKNVAWYQQKPGQPPRLLIYGASTRATGVPARFSGSGSGTEFTLTISRMQPEDFVVYHCQQYSSWPAFGQGTMVEINRTVAAP

SEQ ID NO: 1044 - protein, 119 aa, Homo sapiens
AQYELTQPPSASGTPGQRVTISCSGSSSNIGSNYVHWYQQLPGTAPKLLIYRNNRRPSGVPDRFSGSKSGTSASLAISGLRSEDEADYYCAAWDDSLSGLVVFGGGTKLTVLGQPKAAP

SEQ ID NO: 1045 - protein, 115 aa, Homo sapiens
AQDIQMTQSPSTLSASVGDRVTISCRASQGIGTHLNWYQQKLGNVPKLLIYAASGLQSGVPPRFSGSGSGTDFTLTISSLHPEDSATYFCQQSYSVPRTFGQGTKVEIKRTVAAP

SEQ ID NO: 1046 - protein, 115 aa, Homo sapiens
AQDIQMTQSPSSLSASVGDRVTITCRASQGIGNYLVWYQHKPGNVPRVLIYAASTLQSGVPSRFRGSGSGTDFTLTISGLQPEDVATYYCQKYDGAPFTFGPGTKVDLKRTVAAP

SEQ ID NO: 1047 - protein, 116 aa, Homo sapiens
AQDIQMTQSPFLPVCILQETESPSLAGQVRPLAGILNWYQQKPGTAPKLLIYAASSLQSGVPSRFSGDGSGTDFTLTISSLQPEDFGIYFCQQSYSAPRTFGQGTKVEIKRTVAAP

SEQ ID NO: 1048 - protein, 114 aa, Homo sapiens
AQDIQMTQSPSSLSASVGDRVTITCRASHNIYTSLNWLQQKPGKAPKLLIYGASTLENGVPSRFSGSASGTDFTLTISSLQPEDSATYYCQQSYTSVTFGQGTKLEIRRTVAAP

SEQ ID NO: 1049 - protein, 114 aa, Homo sapiens
AQDIQMTQSPATLSLSPGERATLSCRASQSVSGFLAWYQQKPGQAPRLLIYDNRATGIPARFSGSGSGTDFTLTITRLEPEDFAVYYCQQYGDSSPITFGPGTRLEIKRTVAAP

SEQ ID NO: 1050 - protein, 115 aa, Homo sapiens
AQDIQMTQSPSSVSASVGDSVTISCWTIYDISSWLAWYQQRPGQAPKLLIYAASRLATGVPSRFRGSGSGTDFTLTITNLQPEDVATYYCQQTKDFPLTFGGGTRVDLKRTVAAP

SEQ ID NO: 1051 - protein, 115 aa, Homo sapiens
AQDIQMTQSPSSLSASVGDRVTITCRASQTISRYLNWYQQKPGTAPKLLIYAASSLQSGVPSRFSGDGSGTDFTLTISSLQPEDFGIYFCQQSYSAPRTFGQGTKVEIKRTVAAP

SEQ ID NO: 1052 - protein, 117 aa, Homo sapiens
AQSELTQPPSASGSPGQSLTISCTGGRRDIGNYNYVSWYQQHPGKAPRLIIYDVRKRPSGVPDRFSGSKSGNVAFLTVSGLQTDDEADYYCGSYTGTSNVFGSGTTVTVLGQPKANP

SEQ ID NO: 1053 - protein, 113 aa, Homo sapiens
AQDIQMTQSPGTLSLSPGERATLSCRASQSVYSSYLAWYQQKPGQAPRLLIYANRAIGIPDRFSGSGSGTDFTLTISSMQPEDFATYYCQQSYSTPRFGQGTKLEIKRTVAAP

SEQ ID NO: 1054 - protein, 117 aa, Homo sapiens
AQSVLTQPASVSGSPGQSITISCTGTTSDVGGYKYVSWYQHHPGKVPKLIIYEVNHRPSGVSHRFSGSKSGNTASLIISALQAEDEADYYCYTSDSTPYVFGTGTKVTVLGQPKANP

SEQ ID NO: 1055 - protein, 116 aa, Homo sapiens
AQDIQMTQSPGTLSLSPGERATLSCRASQTVSSNYLAWYQQKPGLAPRLLIYGVSNRAAGIPDRFSGRGSGTDFTLIINRLEPEDFAVYYCQHYGSSAFTFGRGTKLEIERTVAAP

SEQ ID NO: 1056 - protein, 114 aa, Homo sapiens
AQDIQMTQSPSTLSASVGDRVTITCRASQSISNWLAWYQQKPGRAPKLLIYKASTLESGVPSRFSGSGSGTEFTLTISSLQPDDFATYYCQHYNSYSLFGQGTKLEIKRTVAAP

SEQ ID NO: 1057 - protein, 115 aa, Homo sapiens
AQDIQMTQSPSSVSASVGDRVTITCRAGQNIYYWLAWYQQKPGKAPQLLIYAASSLQSGVPSRFSGSGSGTDFTLTISSLQPEDFATYYCQQAKSFPVTFGGGTKVEIKRTVAAP

SEQ ID NO: 1058 - protein, 118 aa, Homo sapiens
AQSELTQPPSASGTPGQRVTISCSGSSSNIGSNYVYWYQQYPGTVPKLLIHSNNQRPSGVPDRFSGPKSGTSASLAISGLRSEDEADYYCATWDNSLSAWVFGGGTKLTVLRQPKAAP

SEQ ID NO: 1059 - protein, 115 aa, Homo sapiens
AQDIQMTQSPSSLSASVGDRVTITCRASQGISSSLAWYQQKPGKVPKLLIYAASTLQSGVPSRFSGSGSGTDFTLTISSLQPEDFATYYCQQSYSTPWTFGQGTKVEIKRTVAAP

SEQ ID NO: 1060 - protein, 115 aa, Homo sapiens
AQDIQMTQSPSSLSASVGDRVTITCRASQGISNYLAWYQQKPGKVPKLLIYAASTLQSGVPSRFSGSGSGTDFTLTISSLQPEDVATYYCQKYNSAPWTFGQGTKVEIKRTVAAP

SEQ ID NO: 1061 - protein, 114 aa, Homo sapiens
AQDIQMTQSPGTLSLSPGERATLSCGASQSVSTTYIAWYQHKPGQPPRLLIYGNRATGIPDRFRGSGSGTDFTLTISRLEPEDFAVYYCQQYGSSPYTFGQGTKLEIKRTVAAP

SEQ ID NO: 1062 - protein, 118 aa, Homo sapiens
AQDIQMTQSPDSLSLSPGERATLSCRASQSISSSYLAWYQQTPGQAPRLLIYHASSRATGVPARFSGSGSGTDFTLTISSLEPEDFAVYYCQQRNNWPPSFTFGGGTKVETKRTVAAP

SEQ ID NO: 1063 - protein, 116 aa, Homo sapiens
AQDIQMTQSPDTLSLSPGERATLSCRASESVSSSYFAWYQQKRGQAPRLLIYGASRRVTGIPDRFSGSGSGTDFTLTITRLEPEDFAVYYCQQYGGSPRSFGQGTKVEIKRTVAAP

SEQ ID NO: 1064 - protein, 118 aa, Homo sapiens
AQSELTQPPSASGTPGQRVTISCSGTLSNIGTNIVSWFQQLPGTAPKLLIYNDHRRPSGVPDRFSGSKSATSASLAISGLQSEDEADYYCAAWDDSLNGVVFGGGTKLTVLSQPKAAP

SEQ ID NO: 1065 - protein, 113 aa, Homo sapiens
AQDIQMTQSPATLSLSPGERAALSCRASQSVSNFLAWYQQKPGQAPRLLIYGNRATDIPARFSGSGSGTDFTLTISSLEPEDFATYYCQQANSFPLTFGGGTKVEIKRTVAAP

SEQ ID NO: 1066 - protein, 115 aa, Homo sapiens
AQDIQMTQSPATLSLSPGERATLSCRASQSVSSYLAWYQQKPGQAPRLLIYGASSRATGIPDRFSGSGSGTDFTLTISSLEPEDFAVYYCQQRGGWPLTFGGGTKVEIRRTVAAP

SEQ ID NO: 1067 - protein, 118 aa, Homo sapiens
AQSALTQPPSASGTPGQTVTISCSGSSSNIGTNFVYWYQQLPGTAPKLLIYRSIKRPSGVPDRFSGSKSGTSASLAISGLRSEDEADYYCAAWDDSLSGVVFGGGTKLTVLGQPKAAP

SEQ ID NO: 1068 - protein, 115 aa, Homo sapiens
AQDIQMTQSPSSVSASVGDRVTITCRASQDVRRFLAWYQQKPGKAPKLLIYAASSLQSGVPSRFSGSGSGTDFTLTISSLQPEDFATYYCQQANSFPITFGQGTRLEIKRTVAAP

SEQ ID NO: 1069 - protein, 118 aa, Homo sapiens
AQYELTQPASVSGSPGQSITISCTGTNTDVGGYNFVSWYQQYPGKAPKLIIFDVTNRPSGVSNRFSGSKSGNTASLTISGLQAEDEADYYCCSYTNTNTLVFAGGTKVTVLGQPKANP

SEQ ID NO: 1070 - protein, 118 aa, Homo sapiens
AQSALTQPASVSGSPGQSITISCTGTSNDIGRTNYVSWYRQDPGRAPKLILFEVSNRPSGISNRFSASKSGSTASLTISGLQADDESDYYCSSCTTAPVCVFGNGTRVTVLGQPKANP

SEQ ID NO: 1071 - protein, 115 aa, Homo sapiens
AQDIQMTQSPSSLSASVGDRVAITCRASQSIDTYLNWYQQKPGKAPKLLIYAASKLEDGVPSRFSGSGTGTDFTLTIRSLQPEDFATYYCQPYNTYPITFGQGTRLEIKRTVAAP

SEQ ID NO: 1072 - protein, 112 aa, Homo sapiens
AQDIQMTQSPSSLSASVGDRVTITCRASQSIGASLNWYQQKPQKAPKLLIYTNLQSGVPSRFSGSGSGTDFTLTISSLLPEDFATYYCQQNYRGRTFGQGTKLEIKRTVAAP

SEQ ID NO: 1073 - protein, 116 aa, Homo sapiens
AQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSRYTFGQGTKLEIKRTVAAP

SEQ ID NO: 1074 - protein, 115 aa, Homo sapiens
AQDIQMTQSPSSLSASVGDRVTITCRASQAISNYLAWYQQQPGKVPKLLISAASTLQSGVPSRFSGSGSGTDFTLSISSLQPEDVATYYCQTYYSVPFTFGPGTKVDFKRTVAAP

SEQ ID NO: 1075 - protein, 115 aa, Homo sapiens
AQDIQMTQSPSSLSASVGDRVTITCRASLSVSGYLNWYQHKPGRAPNLLIYATSSLQSGVPSRFSGSGSGTDFTLTVSSLQPEDLATYYCQQSYSSPYTFGQGTKVEIKGTVAAP

SEQ ID NO: 1076 - protein, 118 aa, Homo sapiens
AQSELTQPPSASGSPGQSVTISCTGTSSDVGAYNYVSWYQQHPGKAPKLIIYEVNKRPSGVPDRFSASKSGNTASLTVSGLQAEDEADYYCNSYAGSNSLIFGGGTKLTVLGQPKAAP

SEQ ID NO: 1077 - protein, 113 aa, Homo sapiens
AQDIQMTQSPSSLSASVGDRVTLTCRASQSIANYLNWYQQKPGKAPKLLVYAASRLHSGVPSRFSGRGSGTDFTLTITSLEPDDLATYYCQQSHDLTFGGGTKVEIKRTVAAP

SEQ ID NO: 1078 - protein, 115 aa, Homo sapiens
AQDIQMTQSPSTLSASVGDRVTITCRASQSISSWLAWYQQKPGEAPKLLIYAASSLRNGVPSRFIGSGSGTDFTLTISSLQPEDFATYYCQQSYSTPPTFGGGTKVEIKRTVAAP

SEQ ID NO: 1079 - protein, 111 aa, Homo sapiens
AQDIQMTQSPATLSASVGDRVTITCRASQSVSRWLAWYQQKPGKAPKLLIYKASTLESGVPSRFSGSGSGTEFTLTISSLQPDDFATYYCQQYGAFGQGTKVEIRRTVAAP

SEQ ID NO: 1080 - protein, 115 aa, Homo sapiens
AQDIQMTQSPSSVSASVGDRVTITCRASQGISSWLAWYQQKPGKAPKLLIYAASSLQSGVPSRFSGSGSGTDFTLTISSLQPEDFATYYCQQANSFPYTFGQGTKLEIKRTVAAP

SEQ ID NO: 1081 - protein, 115 aa, Homo sapiens
AQDIQMTQSPGTLSLSPGERATLSCRPSQSVYSNYLAWYQQKPGQAPRLLIYGASTRATGIPDRFSGSASGTDFTLTISRLEPEDFAVYYCQQYGNSYTFGPGTKVDIKRTVAAP

SEQ ID NO: 1082 - protein, 108 aa, Homo sapiens
AQDIQMTQSPSFVSASIGDRVTITCRASQSIGTLLNWYQHKPGTVPSLLIYGNLRGGVPARFSGSGSGTDFTLTISSLQPEDFATYYCQHDTFGGGTKVDIKRTVAAP

SEQ ID NO: 1083 - protein, 118 aa, Homo sapiens
AQSELTQPASVSGSPGQSITISCTGTSSDVGAYNYVSWYQQHPGKVPKLMIYEVSNRPSGVSNRFSGSKSGNTASLTISGLQAEDEADYYCNSYTTSATLVFGGGTKLTVLSQPKAAP

SEQ ID NO: 1084 - protein, 118 aa, Homo sapiens
AQSELTQPASVSGPPGQSITISCTGTSSDVGGYNYVSWYQQHPGKAPKLIIYEVSNRPSGVSYRFSASKSDNTASLTISGVQAEDEADYYCSSYKRGGTYVFGTGTTVIVLGQPKANP

SEQ ID NO: 1085 - protein, 115 aa, Homo sapiens
AQDIQMTQSPSTLSASVGDRVTITCRASQSISSWLAWYQQKPGKVPKLLIHAASTLQSGVPSRFSGSGSGTDFTLTISSLQPEDVATYYCQKYNSAPLTFGGGTKVEIKRTVAAP

SEQ ID NO: 1086 - protein, 118 aa, Homo sapiens
AQYELTQPPSASGTPGQRVTISCSGSSSDIGSNTVNWYQQLPGTAPKLLIYSNNQRPSGVPDRFSGSKSGTSASLAISGLQSEDEADYYCAAWDDSLNGYVFGTGTKVTVLGQPKANP

SEQ ID NO: 1087 - protein, 116 aa, Homo sapiens
AQDIQMTQSPGTLSLSPGERATLSCRASQSVSGSYLAWYQQKPGQAPSLLIYGAYSRATGIPDRFSGSGSGTDFTLTISRLEPEDFAVYYCQHYGSSPRTFGGGTKVEIKRTVAAP

SEQ ID NO: 1088 - protein, 118 aa, Homo sapiens
AQSVLTQPASVSGSPGQSITISCTGTSSDVGGYNYVSWYQQHPGQPPKLIIYEVSNRASGVSNRFSGSKFGNTASLTISGLQSEDEADYHCSSYTSSTTLLFGGGTRLTVLGQPKAAP

SEQ ID NO: 1089 - protein, 118 aa, Homo sapiens
AQSVLTQPASVSGSPGQSITISCTGTNTDVGGYNLVSWYQQHPGKAPKLIIYEVSNRPSGVSNRFSGSKSGNTASLTISGLQAEDEVDYYCGSYTSSSTHVFGSGTKVTVLGQPKANP

SEQ ID NO: 1090 - protein, 118 aa, Homo sapiens
AQDIQMTQSPGTLSLSPGERATLSCRASQTVSSTYLAWYQQKPGQAPRLLIYGASSRATGIPDRFSGGGSGTDFTLTISRLEPEDFAVYYCQQYGSSPPRYTFGQGTKLEIKRTVAAP

SEQ ID NO: 1091 - protein, 118 aa, Homo sapiens
AQYELTQPASVSGSPGQSITISCTATSSDLGSYNFVSWYQQHPDKAPKLMIFEVSRRPSGVSNRFSGSKSGNTASLTISGLQAEDEADYYCCSYAGSNTYVFGTGTKVTVLGQPKANP

SEQ ID NO: 1092 - protein, 118 aa, Homo sapiens
AQSELTQPASVSGSPGQSITISCTGTSSDVGGYNYLSWYQQHPGKAPKLMIYGVSNRPSGVSTRFSGSKSGNTASLTISGLQAEDEADYYCSSYTSTGTRVFGGGTRLTVLGQPKAAP

SEQ ID NO: 1093 - protein, 117 aa, Homo sapiens
AQDIQMTQSPATLSVSPGERATLSCRASQSVSSNLAWYQQKPGQAPRLLIYGASTRATGIPARFSGSGSGTEFTLTISSLQSEDFAVYYCQQNNNWPPSFTFGPGTKVDIKRTVAAP

SEQ ID NO: 1094 - protein, 115 aa, Homo sapiens
AQDIQMTQSPSTLSASLGDRVIITCRASQGIRSWLAWYQQKPGKAPKLLIYAASSLQSGVPSRFSGSGSGTDFTLTISSLQPEDFATYYCQQSYSTPWTFGQGTKVEIKRTVAAP

SEQ ID NO: 1095 - protein, 118 aa, Homo sapiens
AQSELTQPASVSGSPGQSITISCTGTSTDVGGYNYVSWYQKHPGKAPKLMIYDVSNRPSGVSNRFSGSKSGNTASLTISGLQAEDEADYYCSSYTNTITVVFGGGTKLTVLGQPKAAP

SEQ ID NO: 1096 - protein, 116 aa, Homo sapiens
AQDIQMTQSPGTLSLSPGERATLSCRASQSVVSNFLAWYQQKPGQAPRLLIYGASSRATGIPDRFSGSGSGTDFILTISRLEPEDFAVYYCQQYGSSPYSFGQGTKLEIKRTVAAP

SEQ ID NO: 1097 - protein, 118 aa, Homo sapiens
AQYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGQPKANP

SEQ ID NO: 1098 - protein, 115 aa, Homo sapiens
AQDIQMTQSPSSLSASVGDRVTITCRASQSISSYLNWYQQKPGKAPKLLIYAASSLQSGVPSRFSGSGSGTDFTLTISSLHPEDFATYYCQQTYSTLFTFGPGTKVHIKRTVAAP

SEQ ID NO: 1099 - protein, 114 aa, Homo sapiens
AQYELTQDPAVSVGQTVRITCQGDSLRSYYASWYQQKPGQAPVLVIYSKSNRPSGIPDRFSGSSSGSTASLTITGAQAEDEADYYCNSRDSSGNHLVFGGGTKLTVLGQPKAAP

SEQ ID NO: 1100 - protein, 115 aa, Homo sapiens
AQDIQMTQSPSSLSASVGDRVTITCRASQSISSYLNWYQQKPEKAPQLLIFAASSLQSGVPSRFSGSGSGTDFTLTISSLQPEDFATYYCQQSYNAPWTFGQGTKVEIRRTVAAP

SEQ ID NO: 1101 - protein, 116 aa, Homo sapiens
AQDIQMTQSPATLSLSPGDRATLSCRASQRVSSTFLAWYQQRPGQAPRLVIFGTSSRATGIPDRFSGSGSGTDFTLTISRLEPEDFAVYYCHQYGSSPRTFGQGTKVEIKRTVAAP

SEQ ID NO: 1102 - protein, 116 aa, Homo sapiens
AQDIQMTQSPGTLSLSPGDRATLSCRASQSVSSNYLAWYQQKPGQAPRLLIYGASSRATGIPDRFSGSGSGTDFTLTISRLEPEDFGVYYCQQFGSSLFTFGPGTKVNIKRTVAAP

SEQ ID NO: 1103 - protein, 117 aa, Homo sapiens
AQDIQMTQSPGTLSLSPGERATLSCRASQSVSSSYLAWYQQKPGQAPRLLIYGASSRATGIPDRFSGSGSGTEFTLTISSLQSEDSAVYYCQQYNNWPPLTFGGGTKVEIKRTVAAP

SEQ ID NO: 1104 - protein, 111 aa, Homo sapiens
AQSALTQPLSVSVGQTARITCGGNNIGSKNVHWYQQKPGQAPVLVIYRDSNRPSGIPERFSGSNSGNTATLTISGAQAGDEADYYCQVWDSSTVFGGGTKLTVLGQPKAAP

SEQ ID NO: 1105 - protein, 113 aa, Homo sapiens
AQDIQMTQSPSSLSASVGDRVTITCRASQTIRTYLNWYQQKPGIAPKFLIYDNLQTGVPSRFSGSGSGTHFTLTISSLQPEDFGTYYCQQSYGGPPTFGRGTKIEIKRTVAAP

SEQ ID NO: 1106 - protein, 116 aa, Homo sapiens
AQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSSFTFGPGTKVDIKRTVAAP

SEQ ID NO: 1107 - protein, 115 aa, Homo sapiens
AQDIQMTQSPSSLSASVGDRVTITCRASQSINSYLNWYQQKPGKAPNLLIYAASSLQNGVPSRFSGSGSGTDFTLTISSLQPEDFAAYYCQQSYSTPLTFGGGTKVEIKRTVAAP

SEQ ID NO: 1108 - protein, 115 aa, Homo sapiens
AQDIQMTQSPSSLSASVGDRVTITCRASQSISSYLNWYQQKPGKAPKLLIYAASSLQSGVPSRFSGSGSGTDFTLTISSLQPEDFATYYCQQSYSTLVTFGQGTKLEIKRTVAAP

SEQ ID NO: 1109 - protein, 115 aa, Homo sapiens; identical to SEQ ID NO: 1060

SEQ ID NO: 1110 - protein, 116 aa, Homo sapiens
AQDIQMTQSPATLSLSPGERATLSCRASQSVGGYLAWYQQKPGQAPRLLIYDASKRATGIPARFSGSGSGTDFTLTISSLEPEDFAVYYCQQRSKWPPYTFGQGTKLEIKRTVAAP

SEQ ID NO: 1111 - protein, 118 aa, Homo sapiens
AQSELTQPASVSGSPGQSIAISCTGTSSDIGAYPFVSWYQQHPGKAPKLLIYGVTWFGVSDRFSGSKSGSTASLTISGLQAEDEADYYCSSYAGGRNLPYVFGTGTTVTVLGQPKANP

SEQ ID NO: 1112 - protein, 115 aa, Homo sapiens
AQDIQMTQSPSSLSASVGDRVTITCRASQGISSWLAWYQQRPERAPKSLIYAASSLERGVPSRFRGSGSGTDFTLTISSLQPEDFGTYYCQQYHNFPLTFGGGTRVEINRTVAAP

SEQ ID NO: 1113 - protein, 118 aa, Homo sapiens
AQSALTQPASVSGSPGQSITISCTGTSSDVGSYKLVSWYQQHPGKAPKLMIYEGSKRPSGVSNRFSGSKSGNTASLTISGLQAEDEADYYCCSYAGSSTWVFGGGTKLTVLGQPKAAP

SEQ ID NO: 1114 - protein, 116 aa, Homo sapiens
AQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAP

SEQ ID NO: 1115 - protein, 114 aa, Homo sapiens
AQSALTQPPSVSVSPGQTVSITCSGDDLGGRHVSWFQQLSGQSPVLVIYQDDKRPSGIPERFSGSNSGNTATLTISGTQSVDEGDYYCLAWHNYKYVFGSGTTVTVLRQPKANP

SEQ ID NO: 1116 - protein, 118 aa, Homo sapiens
AQSELTQPASVSGSPGQSITISCTGTSSDVGGYNYVSWYQQHPGKAPKLMIYEVSNRPSGVSNRFSGSKSGNTASLTISGLQAEDEADYYCSSYTSSSTWVFGGGTKLTVLGQPKAAP

SEQ ID NO: 1117 - protein, 113 aa, Homo sapiens
AQDIQMTQSPVTLSLSPGDRATLSCRASQSVSFNLAWYQHKPGQAPRLLMFDNRATGIPDRFSGSGSGTDFTLTIKRLEPEDFAVYYCQQYGTSPFTFGPGTNVDVKRTVAAP

SEQ ID NO: 1118 - protein, 117 aa, Homo sapiens
AQDIQMTQSPGTLSLSPGERATLSCRASQSVSNSYLAWYQQRPGQAPRLLIYGASSRATGIPDRFSGSGSGTEFTLTISRLEPEDFAVYYCQQFGSSTGYTFGQGTKLELKRTVAAP

SEQ ID NO: 1119 - protein, 114 aa, Homo sapiens
AQSALTQPPSVSVSPGQTASITCFGDKLGDKYGSWYQQKPGQSPVLVLYQYWKRPSGIPERFSGSNSGNTATLTINVTQTMDEADYYCQAWDSNTVVFGGGTKLTVLGQPKAAP

SEQ ID NO: 1120 - protein, 116 aa, Homo sapiens
AQDIQMTQSPSSLSASVGDRVTITCLASQSISSYLNWYQQKPGKAPKLLIYDASSLESGVPSRFSGSGSGTDFTLTISSLQPEDFAIYYCQQFNGYPPITFGQGTRLEIKRTVAAP

SEQ ID NO: 1121 - protein, 116 aa, Homo sapiens
AQDIQMTQSPGTLSLSPGDRATLSCRASQSVGSDYLAWYQQKPGQAPRLLIYGASSRATGIPDRFSGSGSGTDFTLTISRLEPEDFAVYYCQQYGSSLYTFGQGTKLEIKRTVAAP

SEQ ID NO: 1122 - protein, 109 aa, Homo sapiens
AQDIQMTQSPATLSLSPGERATLSCRASQSVSSYLAWYQQKPGQAPRLLIYDNRATGIPARFSGSGSGTDFTLTISSLEPEDFAVYYCQQRSNFGGGTKVEIKRTVAAP

SEQ ID NO: 1123 - protein, 115 aa, Homo sapiens
AQDIQMTQSPLSLSASVGDRVTITCRASQTFNNYLNWYQQKPGKAPKLLIYAASTLQSGVPSRFSGSGSGTDFTLTISSLQPEDFATYYCQQANSFPFTFGPGTKVDIKRTVAAP

SEQ ID NO: 1124 - protein, 116 aa, Homo sapiens
AQDIQMTQSPSSLSASVGDRVTITCRASQGIGNYLAWYQQKPGKAPNLLIYKTSNLQSGVPSRFRGSGSGTEFTLTITSVQPDDFATYFCQRYDSYSQYIFGQGTKLETKRTVAAP

SEQ ID NO: 1125 - protein, 116 aa, Homo sapiens
AQYELTQPPSVSVSPGQTATITCSGDKLEEKYVCWYQQKPGQSPAVVIYQDTKRPSGVPDRFSGSKSGTSASLAISGLRSEDEADYYCATWDDSLSGPVFGGGTKLTVLGQPKAAP

SEQ ID NO: 1126 - protein, 115 aa, Homo sapiens
AQDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKRTVAAP

SEQ ID NO: 1127 - protein, 115 aa, Homo sapiens
AQDIQMTQSPATLSVSPGEGATLSCRASQSVGNSLAWYQQKPGQAPRVLVYGASTRASGIPARFSGSGSVTEFTLTISSLQSEDFAVYYCQEYNKWPITFGQGTRLERKRTVAAP

SEQ ID NO: 1128 - protein, 116 aa, Homo sapiens
AQDIQMTQSPGTLSLSPGERATLSCRASQSVSSNYLAWYQQKPGQAPRLLMYGASYRATGIPDRFSGSGSGTDFTLTISSLQPEDFATYYCQQSYSTPWTFGQGTKVEIKRTVAAP

SEQ ID NO: 1129 - protein, 113 aa, Homo sapiens
AQDIQMTQSPSSLSASVGDRVTITCRASQSISRYLNWYQQKPGKAPKLLIYANLQSGVPSRFSGSGSGRDYTLTISSLQPEDFVTYYCQQSYSTPWTFGQGTKVEIKRTVAAP

SEQ ID NO: 1130 - protein, 115 aa, Homo sapiens
AQDIQMTQSPSSFSASTGDRVTITCRASQSISRWLAWYQQKPGKAPKLLIYEASTLESGVPSTFSGSGSGTEFTLTISSLQPDDFATYYCQQYNSYPLTFGGGTKVEIKRTVAAP

SEQ ID NO: 1131 - protein, 115 aa, Homo sapiens
AQDIQMTQSPSSVSASVGDRVTITCRASQDIRTWLAWYQQKSGKAPKLLIYSSSSLQSGISSRFSGSGSGTDFTLTISNLQPEDSAIYYCQQATTFPWTFGQGTKVEIKRTVAAP

SEQ ID NO: 1132 - protein, 119 aa, Homo sapiens
AQSALTQPASVSGSPGQSITISCTGTSSDVGGYNYVSWYQQHPGKAPKLMIYDVSKRPSGVSNRFSGSKSGNTASLTISGLQAEDEADYYCSSYTSSITLVVFGGGTKLTVLSQPKAAP

SEQ ID NO: 1133 - protein, 118 aa, Homo sapiens
AQYELTQPRSVSGSPGQSVTISCTGTSSDVGGFNYVSWYQQHPGKAPKLMIYDVSKRPSGVPDRFSGSKSGTTASLTISGLQADDEADYYCCSYTGNYTYVFGTGTKVTVLGQPKANP

SEQ ID NO: 1134 - protein, 119 aa, Homo sapiens
AQSALTQPASVSGSPGQSITISCSGTSSDVGAYYHVSWYQQHPGKAPKLMIYDVSNRPSGVSNRFSGSKSGNTASLTISGLQAEDEADYYCSLYIGTSTPWVFGGGTKLTVLGQPKAAP

SEQ ID NO: 1135 - protein, 115 aa, Homo sapiens
AQDIQMTQSPSSLSASVGDRVTITCRASQSITGYLNWYQQKPGKAPKLLIYAASSLQSGVPSRFSGSGSGTDFTLSISSLQPEDFATYYCQQSYSTPYTFGQGTKLEIKRTVAAP

SEQ ID NO: 1136 - protein, 116 aa, Homo sapiens
AQDIQMTQSPSSLSASVGDRVTITCRASQTISSYLNWYQQKPGKAPKLLIYAASSLQSGVPSRFSGGGSGTDFTLTISSLQPEDFATYYCQQSYSTPMYTFGQGTKLYIKRTVAAP

SEQ ID NO: 1137 - protein, 112 aa, Homo sapiens
AQDIQMTQSPGTLSLSPGERATLSCRASQSVSSNYLAWYQQKPGKAPKLLIYAASSLQSGVPSRFSGSGSGTDFTLTISSLQPEDFATYYCQQRWTFGQGTKVEIKRTVAAP

SEQ ID NO: 1138 - protein, 115 aa, Homo sapiens
AQDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKRTVAAP

SEQ ID NO: 1139 - protein, 114 aa, Homo sapiens
AQDIQMTQSPATLSLSAGERATLSCRASQSVNIDVGWYQQKPGQAPRLLIYDASKRATGIPTRFSGSGSGTDFTLTIANLEPEDFAVYYCQQRARWLTFGGGTRLEIKRTVAAP

SEQ ID NO: 1140 - protein, 118 aa, Homo sapiens
AQSELTQPASVSGSPGQSITISCAGTSSDLGGYDYVSWYQQYPGKAPKLIIYQVGRRPSGVSNRFSGSKSGNTASLTISGLQTEDEADYYCSSYTSSRTRVFGGGTRVTVLGQPKAAP

SEQ ID NO: 1141 - protein, 116 aa, Homo sapiens
AQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSSYTFGQGTKLEIKRTVAAP

SEQ ID NO: 1142 - protein, 111 aa, Homo sapiens
AQDIQMTQSPSSLSASVGDRVTITCRAGQTINNYLNWYQQKPGKAPNLLIYANLQSGVPSRFSGSKSGTDFTLTISSLQPEDFATYHCQQYTPFTFGGGTRVEIKGTVAAP

SEQ ID NO: 1143 - protein, 115 aa, Homo sapiens
AQDIQMTQSPSTLSASVGDRVTITCRASQSISSWLAWYQQKPGKAPKLLIYKASSLESGVPSRFSGSGSGTEFTLTISSLQPDDFATYYCQQYNSYRYTFGQGTKLEIKRTVAAP

SEQ ID NO: 1144 - protein, 113 aa, Homo sapiens
AQSVLTQDPAVSVGQTVRFTCQGDSLRNYHPSWYQQKPRQAPVLVMFGRNNRPSGIPDRFSGSTSGGTASLTITATQADDEADYFCSSRDGSGNFLFGGGTKLTVLGQPKAAP

SEQ ID NO: 1145 - protein, 115 aa, Homo sapiens
AQDIQMTQSPSTLSASVGDRVTITCRASQSISSWLAWYQQKPGKAPKLLIYKASSLGSGVPSRFSGSGSGTEFTLTISSLQPDDFATYYCQQYYSYSQTFGQGTKVEIKRTVAAP

SEQ ID NO: 1146 - protein, 115 aa, Homo sapiens
AQDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGPGTKVDIKRTVAAP

SEQ ID NO: 1147 - protein, 114 aa, Homo sapiens
AQDIQMTQSPSSLSASVGDRVTITCRASQSISSYLNWYQQKPGKVPKLLIYAASSLQSGVPSRFSGSGSGTDFTLTISSLQPDDFATYYCQQTFSTWTFGQGTKVEIRRTVAAP

SEQ ID NO: 1148 - protein, 116 aa, Homo sapiens
AQSALTQPPSLSVSAGQTATITCSPSGGGLRNKYVSWYQQRPGQSPFLVIYKDAERPSGIPERFSGSNFGNTATLTIGGTQAMDEADFYCLAWDSTTRVFGGGTKLTVLSQPKAAP

SEQ ID NO: 1149 - protein, 115 aa, Homo sapiens
AQDIQMTQSPSTLSASVGDRVTITCRASQSISSWLAWYQQKPGKAPKLLIYKASSLESGVPSRFSGSGSGTEFTLTISSLQPDDFATYYCQQYNSYPVTFGQGTKLEIKRTVAAP

SEQ ID NO: 1150 - protein, 114 aa, Homo sapiens
AQDIQMTQSPSSLSASVGDRVTITCRASQYISTYLAWYQQKPGKAPKLLIYKASDLESGVPSRFSGSGSGTEFTLTINSLQPDDFATYYCQQYNTYWTFGHGTKVEIKRTVAAP

SEQ ID NO: 1151 - protein, 115 aa, Homo sapiens
AQDIQMTQSPSFLSASVGDRVTITCRASQGISSYLAWYQQKPGKAPKLLIYAASTLQSGVPSRFSGSGSGTEFTLTISSLQPEDFATYYCQQLNSYPRTFGQGTKVEIKRTVAAP

SEQ ID NO: 1152 - protein, 118 aa, Homo sapiens
AQSALTQPASVSGSPGQSITISCTDTSGNVGSYNLVSWYQQHPDKAPKLMIFEVSRRPSGVSDRFSGSKSGNTASLTISGLQAEDEADYYCCSYAGSNTYVFGTGTKVTVLGQPKANP

SEQ ID NO: 1153 - protein, 116 aa, Homo sapiens
AQYELTQPASVSGSPGQSITISCTGTNTDVGGYNYVSWYQQYPGKAPKLMIYEVNHRPSGVSNRFSGSKSGNTASLTISGLQAEDEADYYCSSYYNTYVFGTGTKVTVLGQPKANP

SEQ ID NO: 1154 - protein, 117 aa, Homo sapiens
AQYELTQPASVSGSPGQSITISCTGTSSDIGAYNYVSWYQQHPGKAPKLMIYDVSNRPSGVSNRFSGSKSGNTASLTISGLQAEDEADYYCSSYRSSSLMFGGGTKLTVLGQPKAAP

SEQ ID NO: 1155 - protein, 115 aa, Homo sapiens
AQDIQMTQSPSSVSASVGDRVTITCRASQDVLVSFAWYQQRPGTAPKLLIYAASHLHPGVPSRFSASGSGTDFTLTINGLQPEDFATYYCQQARSFPHTFGQGTRLEKKRTVAAP

SEQ ID NO: 1156 - protein, 118 aa, Homo sapiens
AQYELTQPPSASGTPGQRVTISCSGSSSNIGTNRVNWYQQIPGTAPKLLIYSNNQRPSGVPDRFSDSKSGTSASLAISGLQSEDEADYYCAAWDDSLTGPVFGGGTKVTVLRQPKAAP

SEQ ID NO: 1157 - protein, 117 aa, Homo sapiens
AQDIQMTQSPGTLSLSPGERASLSCRASQSVSSNYLSWYQQKPGQAPRLLIYGTSNRASGIPVRFSGSGSGTDFTLTISRLEPEDFAVYYCQQYGGAPLFIFGPGTRVDIKRTVAAP

SEQ ID NO: 1158 - protein, 114 aa, Homo sapiens
AQSALTQPPSVSVAPGQTASISCSGNILDNSYASWFQQKPGQSPVMVIHRDNKRPSGIPERFSGSTSGNTATLTISGTQAVDEADYYCQAWDRTTGVFGTGTRLTVLRQPKAAP

SEQ ID NO: 1159 - protein, 115 aa, Homo sapiens
AQDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAP

SEQ ID NO: 1160 - protein, 113 aa, Homo sapiens
AQDIQMTQSPATLSLSPGERATLSCRASQSVSSYLAWYQQKPGQAPRLLIYDNRATGIPARFSGSGSGTDFTLTISSLEPEDFAVYYCQQRSNWLWTFGQGTKVEIKRTVAAP

SEQ ID NO: 1161 - protein, 115 aa, Homo sapiens
AQDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIKRTVAAP

SEQ ID NO: 1162 - protein, 118 aa, Homo sapiens
AQYELTQAPSASGTPGQRVTISCSGSRSNIGTNPVNWYQHVPGTAPKLLILVNNQRPSGVPDRFSGSKSGASASLAISGLQSEDEAEYYCATWDGSLNGPVFGGGTKLTVLRQPKAAP

SEQ ID NO: 1163 - protein, 118 aa, Homo sapiens
AQSALTQPRSVSGSPGQSVTISCTGTGSNIDGYNYVSWYQQYPGNAPKLIIYDVGKRPSGVPNRFSGSKSGNTASLTISGLQAEDEADYYCCSYAGSYSYVFGVGTKVTVLGQPKANP

SEQ ID NO: 1164 - protein, 115 aa, Homo sapiens
AQDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIKRTVAAP

SEQ ID NO: 1165 - protein, 115 aa, Homo sapiens
AQSALTQPRSVSGSPGQSVTISCTGTSSDVNYVSWYQQHPGKAPKLMIYAVTKRPSGVPDRFSGSKSGNTASLTVSGLQAEDEADYYCSSYAGSNNLVFGGGTKLTVLGQPKAAP

SEQ ID NO: 1166 - protein, 115 aa, Homo sapiens
AQDIQMTQSPSTLSASVGDRVTITCRASQSISNWLAWYQQKPGKAPKLLIYMASTLESGVPSRFSGSGSGTEFTLTISSLQPADFATYYCQQYNSYSVTFGGGTKVEIKRTVAAP

SEQ ID NO: 1167 - protein, 119 aa, Homo sapiens
AQYELTQPPSASGTPGQRVTISCSGSSSNIGSNYVYWYQQLPGTAPKLLIYRNNQRPSGVPDRFSGSKSGTSASLAISGLRSEDEADYYCAAWDDSLSGHAVFGGGTQLTVLGQPKAAP

SEQ ID NO: 1168 - protein, 118 aa, Homo sapiens
AQSVLTQPPSASGTPGQRVTVSCSGSSSNIGSNIVSWYRQLPGTAPKLLIYSNNRRPSGVPDRFSGSKSGTSASLAISGLQSEDEADYYCAAWDDSLNGHVFGGGTKLTVLRQPKAAP

SEQ ID NO: 1169 - protein, 118 aa, Homo sapiens
AQSALTQPPSASGSPGQSVTISCTGTSSDVGAYNYVSWYQQHPGKAPKLIIYEVNKRPSGVPDRFSASKSGNTASLTVSGLQAEDEADYYCNSYAGSNSLIFGGGTKLTVLGQPKAAP

SEQ ID NO: 1170 - protein, 115 aa, Homo sapiens
AQDIQMTQSPSSLSASVGDRVTITCRASQGIRNDLGWYQQKPGKAPKLLIYAASSLQSGVPSRFSGSGSGTDFTLTISSLQPEDFATYYCLQDYNYPRTFGQGTKVEIKRTVAAP

SEQ ID NO: 1171 - protein, 115 aa, Homo sapiens
AQDIQMTQSPSSLSASVGDRVTITCRASQSISTYLNWYQQKPGKAPNLLIYAASSLQSGVPSRFSGSGSGTDFTLTVSSLQPEDFGTYYCQQYNSFPFSFGQGTRLEINRTVAAP

SEQ ID NO: 1172 - protein, 116 aa, Homo sapiens
AQDIQMTQSPSSVSASVGDRVTITCRASQGISSWLAWYQQKPGKAPKLLIYAASSLQSGVPSRFSGSGSGTDFTLTISSLQPEDFATYYCQQANSFPSLTFGGGTKVEIKRTVAAP

SEQ ID NO: 1173 - protein, 118 aa, Homo sapiens
AQSELTQPPSMSGTPGQRVIISCSGSNSNIGNNFVYWYQQVAGSAPKLLIFRNNQRPSGVPDRFTVSKSGASASLAIGGLRSEDEADYYCAAWDDSLSGVLFGGGTKVTVLGQPKAAP

SEQ ID NO: 1174 - protein, 115 aa, Homo sapiens
AQDIQMTQSPSSLSASVGDRVTITCRASQSISSYLNWYQQKPGKAPKLLIYAASSLQSGVPSRFSGSGSGTDFTLTISSLQPEDFATYYCQQSYSTLYTFGQGTKLEIKRTVAAP

SEQ ID NO: 1175 - protein, 115 aa, Homo sapiens
AQDIQMTQSPATLSLSPGERATLSCRASQSVSSYLAWYQQKPGQAPRLLIYDNRATGIPARFSGSGSGTDFTLTISSLEPEDFAVYYCQQRSNWPSPIAFGQGTRLEIKRTVAAP

SEQ ID NO: 1176 - protein, 118 aa, Homo sapiens
AQSVLTQPPSASGTPGQRVTISCSGGSSNIGSNRVNWYQQVPGTAPKLLIDSNNQRPSGVPDRFSGSKSGTSASLAISGLQSEDEAGYYCAAWDDNLIGPVFGGGTKLTVLGQPKAAP

SEQ ID NO: 1177 - protein, 115 aa, Homo sapiens
AQDIQMTQSPSSLSASVGDRVTITCRASQSISSYLNWYQQKPGKAPKLLIYAASSLQSGVPSRFSGSGSGTDFTLTISSLQPEDFATYYCQQSYSTPWTFGQGTKVEIKRTVAAP

SEQ ID NO: 1178 - protein, 115 aa, Homo sapiens
AQDIQMTQSPSSVSASVGDRVTITCRASQDIASWLAWYQQKPEKVPKLLIYAASSLQSGVPSRFSGSGSGTDFTLTINSLQPEDFATYYCQQANSFPFTFGPGTKVDFKRTVAAP

SEQ ID NO: 1179 - protein, 115 aa, Homo sapiens
AQDIQMTQSPGTLSLSPGERATLSCRASQSVTTFLAWYQRKPGQAPRLLIYGASSRAADIPDRFSGSGSGTDFTLTISRLEPEDLAVYYCQQYRFSPPTFGPGTTVDIRRTVAAP

SEQ ID NO: 1180 - protein, 115 aa, Homo sapiens
AQDIQMTQSPSSLSASVGDRVTITCRASHVINIDLGWYQQKPGKAPKLLIYGASHLQRGVPSRFSGSGSGTVFTLTISGLQPEDFATYYCLQDSFYPRTFGQGTRLEIKRTVAAP

SEQ ID NO: 1181 - protein, 110 aa, Homo sapiens
AQDIQMTQSPGTLSLSPGERATLSCRASQSVSSSYLAWYQQKPGQAPRLLIYDNRATGIPARFSGSGSGTDFTLTISSLEPEDFAVYYCQQWDTFGQGTKLEIKRTVAAP

SEQ ID NO: 1182 - protein, 116 aa, Homo sapiens
AQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSGWTFGQGTKVEIKRTVAAP

SEQ ID NO: 1183 - protein, 119 aa, Homo sapiens
AQSELTQPPSASGTPGQRVTISCSGTNSNIGSNSVFWYQQLSGTAAPKVLILRNSQRPSGVSDRFSGSKSGTSASLAISGLRSEDEADYYCATWDDSLRSPVFGGGTKLTVLGQPKAAP

SEQ ID NO: 1184 - protein, 115 aa, Homo sapiens
AQDIQMTQSPSSLSASVGDRVTITCRTSQTVSTFLNWYQQKPGTAPKLLIYAASRLQSGVPSRFSGSGSETDFTLTISRLQPEDFATYYCQQSFTSPRTFGLGTKVEIKRTVAAP

SEQ ID NO: 1185 - protein, 115 aa, Homo sapiens
AQDIQMTQSPSSVSASVGDRVTITCRASQGISSWLAWYQQKPGKAPKLLIYAASSLQSGVPSRFSGSGSGTDFTLTISSLQPEDFATYYCQQANSFPHTFGQGTKLEIKRTVAAP

SEQ ID NO: 1186 - protein, 116 aa, Homo sapiens
AQDIQMTQSPSSLSASVGDRVAITCRASQSIDTYLNWYQQKPGKAPKLLIYAASKLEDGVPSRFSGSGTGTDFTLTIRSLQPEDFASYFCQQSYSSPGITFGPGTKVEIKRTVAAP

SEQ ID NO: 1187 - protein, 115 aa, Homo sapiens; identical to SEQ ID NO: 1138

SEQ ID NO: 1188 - protein, 115 aa, Homo sapiens
AQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSLTFGQGTRLEIKRTVAAP

SEQ ID NO: 1189 - protein, 118 aa, Homo sapiens
AQYELTQPASVSGSPGQSITISCTGTSSDVGAYNYVSWYQHHPGKAPKLLIYDVSNRPSGISSRFSGSKSGNTASLTISGLQAEDEADYYCSSYTSSYTWVFGGGTKLTVLSQPKAAP

SEQ ID NO: 1190 - protein, 116 aa, Homo sapiens
AQSELTQPASVAGSPGQSITISCTGTSSDVGNFVSWYQQHPGKAPKLMIYDVSRRPSGVSNRFSASKSGTRASLTVSGLQAEDEADYYCSSYAGSNNYVFGTGTKVTVLGQPKANP

SEQ ID NO: 1191 - protein, 115 aa, Homo sapiens
AQDIQMTQSPSSVSASVGDRVTITCRASQGISSWLVWYQQKPGKAPKLLIYAASSLQSGVPSRFSGSGSGTDFTLTISSLQPEDFATYYCQQAKTFPLTFGGGTKVEIKRTVAAP

SEQ ID NO: 1192 - protein, 118 aa, Homo sapiens
AQSALTQPASVSGSPGQSITISCSGTSSDVGAYYHVSWYQQHPGKAPKLMIYEVTNRPSGISNRFSGSKSGNTASLTISGLQADDEADYFCSSYTTSNTLVFGGGTKVTVLGQPKAAP

SEQ ID NO: 1193 - protein, 117 aa, Homo sapiens
AQDIQMTQSPGTLSLSPGDRATLSCRASQSVSSSYLAWYQQKAGQAPRLLIYGAASRATGIPDRFSGSGSGTDFTLTISRLEREDFAVYYCQQYGSSPLITFGQGTRLEIKRTVAAP

SEQ ID NO: 1194 - protein, 121 aa, Homo sapiens
AQDIVMTQTPPSLPVNPGEPASISCRSSQSLVYSDGNTYLNWFQQRPGQSPRRLIYKVSNRDSGVPDRFSGSGSGTDFTLKISRVEAEDVGVYYCMQGTHWQRLTFGGGTKVEIKRTVAAP

SEQ ID NO: 1195 - protein, 114 aa, Homo sapiens
AQDIQMTQSPSSLSASVGDRVTITCRASQGIRRAWYQQKPGKPPKLLINDASSLESGVPSRFSGSGSGTDFTLTISSLQPEDFATYYCQQSYSTPPWTFGQGTKVEIKRTVAAP

SEQ ID NO: 1196 - protein, 115 aa, Homo sapiens
AQDIQMTQSPSSVSASVGDRVTMTCRASRGISNWLAWYQQKPGKAPELLIHSASTLHAGVPSRFSGSGSGTDFTLTISSLQPGDFATYYCQEGNSFPYTFGQGTNLQIKRTVAAP

SEQ ID NO: 1197 - protein, 115 aa, Homo sapiens
AQDIQMTQSPSSLSASVGDRVTITCRASQAISTNLNWYQQKPGKAPKLLIYAASSLQSGVPSRFIGSGSGTDFTLTISSLHPEDFATYHCQQTFSPPHTFGQGTKVEIQRTVAAP

SEQ ID NO: 1198 - protein, 116 aa, Homo sapiens
AQDIQMTQSPGTLSLSPGERATLSCRASQSVSSSYLAWYQQKPGQAPRLLIYGASSRATGIPDRFSGSGSGTDFTLTISSLQLEDFGTYFCQQSYRSPYTFGQGTKVDIKRTVAAP

SEQ ID NO: 1199 - protein, 145 aa, Artificial Sequence
  Synthetically generated peptide
EVQLLESGGGLVQPGGSLRLSCAASGFTFSQYLMAWVRQAPGKGLEWVSSIYPSGGNTNYADSVKGRFTISRDNSKNTLYLQMNSLRAEDTAVYYCARDRSIVPYSSSWYMPRDYYYGMDVWGQGTTVTVSSASTKGPSVFPLAP

SEQ ID NO: 1200 - protein, 131 aa, Artificial Sequence
  Synthetically generated peptide
EVQLLESGGGLVQPGGSLRLSCAASGFTFSHYPMIWVRQAPGKGLEWVSGIYSSGGTTKYADSVKGRFTISRDNSKNTLYLQMNSLRAEDTAVYYCARVGVWYGMDVWGQGTTVTVSSASTKGPSVFPLAP

SEQ ID NO: 1201 - protein, 131 aa, Artificial Sequence
  Synthetically generated peptide
EVQLLESGGGLVQPGGSLRLSCAASGFTFSHYGMNWVRQAPGKGLEWVSSIWSSGGYTTYADSVKGRFTISRDNSKNTLYLQMNSLRAEDTAVYYCARVGIWYSMDVWGQGTTVTVSSASTKGPSVFPLAP

SEQ ID NO: 1202 - protein, 140 aa, Artificial Sequence
  Synthetically generated peptide
EVQLLESGGGLVQPGGSLRLSCAASGFTFSWYAMHWVRQAPGKGLEWVSWISPSGGQTKYADSVKGRFTISRDNSKNTLYLQMNSLRAEDTAVYYCARAKVLRYFDWLLGGDAFDIWGQGTMVTVSSASTKGPSVFPLAP

SEQ ID NO: 1203 - protein, 131 aa, Artificial Sequence
  Synthetically generated peptide
EVQLLESGGGLVQPGGSLRLSCAASGFTFSRYPMGWVRQAPGKGLEWVSSIYPSGGSTYYADSVKGRFTISRDNSKNTLYLQMNSLRAEDTAVYYCARVGVWYGMDVWGQGTTVTVSSASTKGPSVFPLAP

SEQ ID NO: 1204 - protein, 131 aa, Artificial Sequence
  Synthetically generated peptide
EVQLLESGGGLVQPGGSLRLSCAASGFTFSRYTMEWVRQAPGKGLEWVSVIRPSGGTTMYADSVKGRFTISRDNSKNTLYLQMNSLRAEDMAVYYCARVGVWYGMDVWGQGTTVTVSSASTKGPSVFPLAP

SEQ ID NO: 1205 - protein, 131 aa, Artificial Sequence
  Synthetically generated peptide
EVQLLESGGGLVQPGGSLRLSCAASGFTFSHYEMAWVRQAHGKGLEWVSVIYPSGGATRYADSVKGRFTISRDNSKNTLYLQMNSLRAEDTAVYYCARVAQYYGMDVWGQGTTVTVSSASTKGPSVFPLAP

SEQ ID NO: 1206 - protein, 148 aa, Artificial Sequence
  Synthetically generated peptide
EVQLLESGGGLVQPGGSLRLSCAASGFTFSDYRMWWVRQAPGKGLEWVSYIVPSGGQTSYADSVKGRFTISRDNSKNTLYLQMNSLRAEDTAVYYCRSAYQRRTYSSGWYSASGRRGTAEYFQHWGQGTLVTVSSASTKGPSVFPLAP

SEQ ID NO: 1207 - protein, 130 aa, Artificial Sequence
  Synthetically generated peptide
EVQLLESGGGLVQPGGSLRLSCAASGFTFSNYHMDWVRQAPGKGLEWVSVIGPSGGFTRYADSVKGRFTISRDNSKNTLYLQMNSLRAEDTAVYYCARALGGSLDYWGQGTLVTVSSASTKGPSVFPLAP

SEQ ID NO: 1208 - protein, 130 aa, Artificial Sequence
  Synthetically generated peptide
EVQLLESGGGLVQPGGSLRLSCAASGFTFSWYSMTWVRQAPGKGLEWVSSISPSGGATKYADSVKGRFTISRDNSKNTLYLQMNSLRAEDTAVYYCRGAASLPFDYWGQGTLVTVSSASTKGPSVFPLAP

SEQ ID NO: 1209 - protein, 132 aa, Artificial Sequence
  Synthetically generated peptide
EVQLLESGGGLVQPGGSLRLSCAASGFTFSHYLMVWVRQAPGKGLEWVSGIVPSGGYTMYADSVKGRFTISRDNSKNTLYLQMNSLRAEDTAVYYCTRASYSSFGLDYWGQGTLVTVSSASTKGPSVFPLAP

SEQ ID NO: 1210 - protein, 142 aa, Artificial Sequence
  Synthetically generated peptide
EVQLLESGGGLVQPGGSLRLSCAASGFTFSFYAMVWVRQAPGKGLEWVSYISPSGGATWYADSVKGRFTISRDNSKNTLYLQMNSLRAEDTAVYYCAKPSRPRYYYDSSGYYSSAFDIWGQGTMVTVSSASTKGPSVFPLAP

SEQ ID NO: 1211 - protein, 131 aa, Artificial Sequence
  Synthetically generated peptide
EVQLLESGGGLVQPGGSLRLSCAASGFTFSWYQMSWVRQAPGKGLEWVSSIYPSGGATKYADSVKGRFTISRDNSKNTLYLQMNSLRAEDTAMYYCARMGLHHSFDYWGQGTLVTVSSASTKGPSVFPLAP

SEQ ID NO: 1212 - protein, 131 aa, Artificial Sequence
  Synthetically generated peptide
EVQLLESGGGLVQPGGSLRLSCAASGFTFSPYMMGWVRQAPGKGLEWVSSIRSSGGATAYADSVKGRFTISRDNSKNTLYLQMNSLRAEDTATYYCARVGVWYGMDVWGQGTTVTVSSASTKGPSVFPLAP

SEQ ID NO: 1213 - protein, 131 aa, Artificial Sequence
  Synthetically generated peptide
EVQLLESGGGLVQPGGSLRLSCAASGFTFSNYNMHWVRQAPGKGLEWVSVIYPSGGYTVYADSVKGRFTISRDNSKNTLYLQMNSLRAEDTAVYYCARRGNWGGIDYWGQGTLVTVSSASTKGPSVFPLAP

SEQ ID NO: 1214 - protein, 131 aa, Artificial Sequence
  Synthetically generated peptide
EVQLLESGGGLVQPGGSLRLSCAASGFTFSNYKMQWVRQAPGKGLEWVSSIYSSGGKTVYADSVKGRFTISRDNSKNTLYLQMNSLRAEDTAVYYCARTPGYNYFDYWGQGTLVTVSSASTKGPSVFPLAP

SEQ ID NO: 1215 - protein, 127 aa, Artificial Sequence
  Synthetically generated peptide
EVQLLESGGGLVQPGGSLRLSCAASGFTFSHYWMVWVRQAPGKGLEWVSWIGPSGGGTVYADSVKGRFTISRDNSKNTLYLQMNSLRAEDTAVYYCRNGGFDSWGRGTLVTVSSASTKGPSVFPLAP

SEQ ID NO: 1216 - protein, 140 aa, Artificial Sequence
  Synthetically generated peptide
EVQLLESGGGLVQPGGSLRLSCAASGFTFSWYHMYWVRQAPGKGLEWVSYIRPSGGNTNYADSVKGRFTISRDNSKNTLYLQMNSLRAEDTAMYYCARDRRGYSSSKGYYYYGMDVWGQGTTVTVSSASTKGPSVFPLAP

SEQ ID NO: 1217 - protein, 131 aa, Artificial Sequence
  Synthetically generated peptide
EVQLLESGGGLVQPGGSLRLSCAASGFTFSHYLMYWVRQAPGKGLEWVSSIYPSGGFTAYADSVKGRFTISRDNSKNTLYLQMNSLRAEDTAVYYCARRGVYGTFDIWGQGTMVTVSSASTKGPSVFPLAP

SEQ ID NO: 1218 - protein, 145 aa, Artificial Sequence
  Synthetically generated peptide
EVQLLESGGGLVQPGGSLRLSCAASGFTFSHYFMHWVRQAPGKGLEWVSYISSSGGLTGYADSVKGRFTISRDNSKNTLYLQMNSLRAEDTAVYYCARRGPVYYYDSSGSHSAFDIWGQGTMVTVSKRLHQGPIGLPASTLLQEH

SEQ ID NO: 1219 - protein, 131 aa, Artificial Sequence
  Synthetically generated peptide
EVQLLESGGGLVQPGGSLRLSCAASGFTFSWYQMMWVRKAPGKGLEWVSYIRSSGGKTDYADSVKGRFTISRDNSKNTLYLQMNSLRAEDTAVYYCARVGVWYGMDVWGQGTTVTVSSASTKGPSVFPLAP

SEQ ID NO: 1220 - protein, 138 aa, Artificial Sequence
  Synthetically generated peptide
EVQLLESGGGLVQPGGSLRLSCAASGFTFSNYLMYWVRQAPGKGLEWVSSIRPSGGNTLYADSVKGRFTISRDNSKNTLYLQMNSLRAEDTAVYYCRRGILTGYYWGYYYYMDVWGKGTTVTVSSASTKGPSVFPLAP

SEQ ID NO: 1221 - protein, 145 aa, Artificial Sequence
  Synthetically generated peptide
EVQLLESGGGLVQPGGSLRLSCAASGFTFSPYQMWWVRQAPGKGLEWVSSISSSGGLTRYADSVKGRFTISRDNSKNTLYLQMNSLRAEDMAVYYCARVKLNYYGSGSYSLDAFDIWGQGTNGHRLKRLHQGPIGLPASTLLQEH

SEQ ID NO: 1222 - protein, 131 aa, Artificial Sequence
  Synthetically generated peptide
EVQLLESGGGLVQPGGSLRLSCAASGFTFSNYPMVWVRQAPGKGLEWVSVIGPSGGKTKYADSVKGRFTISRDNSKNTLYLQMNSLRAEDTAVYYCARVGVWYGMDVWGQGTTVTVSSASTKGPSVFPLAP

SEQ ID NO: 1223 - protein, 138 aa, Artificial Sequence
  Synthetically generated peptide
EVQLLESGGGLVQPGGSLRLSCAASGFTFSPYYMQWVRQAPGKGLEWVSGISSSGGSTQYADSVKGRFTISRDNSKNTLYLQMNSLRAEDTAVYYCARSQRRTYYPNFGDAFDIWGQGTMVTVSSASTKGPSVFPLAP

SEQ ID NO: 1224 - protein, 145 aa, Artificial Sequence
  Synthetically generated peptide
EVQLLESGGGLVQPGGSLRLSCAASGFTFSKYKMGWVRQAPGKGLEWVSYIRPSGGMTFYADSVKGRFTISRDNSKNTLYLQMNSLRAEDTAVYYCTREHYQASYSSSAWFRMVPAGAFDIWGQGTMVTVSSASTKGPSVFPLAP

SEQ ID NO: 1225 - protein, 143 aa, Artificial Sequence
  Synthetically generated peptide
EVQLLESGGGLVQPGGSLRLSCAASGFTFSFYSMMWVRQAPGKGLEWVSGISSSGGTTKYADSVKGRFTISRDNSKNTLYLQMNSLRAEDTAVYYCRGTNYDYVWGSYRSHYYYYGMDVWGQGTTVTVSSASTKGPSVFPLAP

SEQ ID NO: 1226 - protein, 136 aa, Artificial Sequence
  Synthetically generated peptide
EVQLLESGGGLVQPGGSLRLSCAASGFTFSMYGMTWVRQAPGKGLEWVSGISPSGGRTYYADSVKGRFTISRDNSKNTLYLQMNSLRAEDTAVYYCAKHRRDYVWWTYGMDVWGQGTTVTVSSASTKGPSVFPLAP

SEQ ID NO: 1227 - protein, 139 aa, Artificial Sequence
  Synthetically generated peptide
EVQLLESGGGLVQPGGSLRLSCAASGFTFSRYGMQWVRQAPGKGLEWVSYIYPSGGGTVYADSVKGRFTISRDNSKNTLYLQMNSLRAEDTAVYYCARRVAVAGSWYYYYYGMDVWGQGTTVTVSSASTKGPSVFPLAP

SEQ ID NO: 1228 - protein, 127 aa, Artificial Sequence
  Synthetically generated peptide
EVQLLESGGGLVQPGGSLRLSCAASGFTFSHYVMSWVRQAPGKGLEWVSRIYPSGGQTYYADSVKGRFTISRDNSKNTLYLQMNSLRAEDTAVYYCRAGWFDPWGQGTLVTVSSASTKGPSVFPLAP

SEQ ID NO: 1229 - protein, 128 aa, Artificial Sequence
  Synthetically generated peptide
EVQLLESGGGLVQPGGSLRLSCAASGFTFSRYAMFWVRQAPGKGLEWVSSISPSGGKTRYADSVKGRFTISRDNSKNTLYLQMNSLRAEDTAVYYCRGGTALDYWGQGTLVTVSSASTKGPSVFPLAP

SEQ ID NO: 1230 - protein, 131 aa, Artificial Sequence
  Synthetically generated peptide
EVQLLESGGGLVQPGGSLRLSCAASGFTFSRYAMHWVRQAPGKGLEWVSSIWPSGGATFYADSVKGRFTISRDNSKNTLYLQMNSLRAEDTAVYYCATSPTLNAFHIWGQGTMVTVSSASTKGPSVFPLAP

SEQ ID NO: 1231 - protein, 131 aa, Artificial Sequence
  Synthetically generated peptide
EVQLLESGGGLVQPGGSLRLSCAASGFTFSNYIMSWVRQAPGKGLEWVSSIWPSGGHTRYADSVKGRFTISRDNSKNTLYLQMNSLRAEDTAVYYCARAGSYYAGDYWGQGTLVTVSSASTKGPSVFPLAP

SEQ ID NO: 1232 - protein, 139 aa, Artificial Sequence
  Synthetically generated peptide
EVQLLESGGGLVQPGGSLRLSCAASGFTFSHYTMVWVRQAPGKGLEWVSSIYSSGGRTNYADSVKGRFTISRDNSKNTLYLQMNSLRAEDTAVYYCARIVVVPSAQFYFYYGMDVWGQGTTVTVSSASTKGPSVFPLAP

SEQ ID NO: 1233 - protein, 137 aa, Artificial Sequence
  Synthetically generated peptide
EVQLLESGGGLVQPGGSLRLSCAASGFTFSPYIMSWVRQAPGKGLEWVSSIVSSGGVTLYADSVKGRFTISRDNSKNTLYLQMNSLRAEDTAVYYCTKNINLRYDILTGYFDIWGQGTTVTVSSASTKGPSVFPLAP

SEQ ID NO: 1234 - protein, 126 aa, Artificial Sequence
  Synthetically generated peptide
EVQLLESGGGLVQPGGSLRLSCAASGFTFSHYVMNWVRQAPGKGLEWVSRIYPSGGVTVYADSVKGRFTISRDNSKNTLYLQMNSLRAEDTAVYYCRYGMDVWGQGTMVTVSSASTKGPSVFPLAP

SEQ ID NO: 1235 - protein, 139 aa, Artificial Sequence
  Synthetically generated peptide
EVQLLESGGGLVQPGGSLRLSCAASGFTFSHYLMHWVRQAPGKGLEWVSSIYPSGGKTQYADSVKGRFTISRDNSKNTLYLQMNSLRAEDTAVYYCARVFGYYDFWSGYPGAFDYWGQGTLVTVSSASTKGPSVFPLAP

SEQ ID NO: 1236 - protein, 127 aa, Artificial Sequence
  Synthetically generated peptide
EVQLLESGGGLVQPGGSLRLSCAASGFTFSHYLMGWVRQAPGKGLEWVSVIWPSGGITKYADSVKGRFTISRDNSKNTLYLQMNSLRAEDTAVYYCRNGGFDSWGQGTLVTVSSASTKGPSVFPLAP

SEQ ID NO: 1237 - protein, 127 aa, Artificial Sequence
  Synthetically generated peptide
EVQLLESGGGLVQPGGSLRLSCAASGFTFSRYWMWWVRQAPGKGLEWVSSIGPSGGATRYADSVKGRFTISRDNSKNTLYLQMNSLRAEDTAVYYCTTGSAGNWGQGTLVTVSSASTKGPSVFPLAP

SEQ ID NO: 1238 - protein, 143 aa, Artificial Sequence
  Synthetically generated peptide
EVQLLESGGGLVQPGGSLRLSCAASGFTFSLYLMEWVRQAPGKGLEWVSSIGSSGGATWYADSVKGRFTISRDNSKNTLYLQMNSLRAEDTAMYYCATDTSRVAGTRLRNYYYYYGMDVWGQGTTVTVSSASTKGPSVFPLAP

SEQ ID NO: 1239 - protein, 134 aa, Artificial Sequence
  Synthetically generated peptide
EVQLLESGGGLVQPGGSLRLSCAASGFTFSRYMMEWVRQAPGKGLEWVSGISPSGGTTKYADSVKGRFTISRDNSKNTLYLQMNSLRAEDTAVYYCTRGGYNNYYYALDVWGQGTTVTVSSASTKGPSVFPLAP

SEQ ID NO: 1240 - protein, 145 aa, Artificial Sequence; identical to SEQ ID NO: 722
  Synthetically generated peptide

SEQ ID NO: 1241 - protein, 131 aa, Artificial Sequence
  Synthetically generated peptide
EVQLLESGGGLVQPGGSLRLSCAASGFTFSMYRMFWVRQAPGKGLEWVSVIGPSGGQTAYADSVKGRFTISRDNSKNTLYLQMNSLRAEDTAVYYCARVGVWYGMDVWGQGTTVTVSSASTKGPSVFPLAP

SEQ ID NO: 1242 - protein, 133 aa, Artificial Sequence
  Synthetically generated peptide
EVQLLESGGGLVQPGGSLRLSCAASGFTFSKYPMTWVRQAPGKGLEWVSSISSSGGKTQYADSVKGRFTISRDNSKNTLYLQMNSLRAEDTAVYYCTRGGSSTLYFMDVWGQGTTVTVSSASTKGPSVFPLAP

SEQ ID NO: 1243 - protein, 137 aa, Artificial Sequence
  Synthetically generated peptide
EVQLLESGGGLVQPGGSLRLSCAASGFTFSHYPMSWVRQAPGKGLEWVSYIRSGGYTTYADSVKGRFTISRDNSKNTLYLQMNSLRAEDTAVYYCARERVFCSGGRCGSYFDYWGQGTLVTVSSASTKGPSVFPLAP

SEQ ID NO: 1244 - protein, 131 aa, Artificial Sequence
  Synthetically generated peptide
EVQLLESGGGLVQPGGSLRLSCAASGFTFSHYSMLWVRQAPGKGLEWVSSIRPSGGFTKYADSVKGRFTISRDNSKNTLYLQMNSLRAEDTAVYYCARRGVWDAFDIWGQGTMVTVSSASTKGPSVFPLAP

SEQ ID NO: 1245 - protein, 131 aa, Artificial Sequence
  Synthetically generated peptide
EVQLLESGGGLVQPGGSLRLSCAASGFTFSLYAMHWVRQAPGKGLEWVSSIRPSGGLTKYADSVKGRFTISRDNSKNTLYLQMNSLRAEDTAVYYCARVGVWYGMDVWGQGTTVTVSSASTKGPSVFPLAP

SEQ ID NO: 1246 - protein, 131 aa, Artificial Sequence
  Synthetically generated peptide
EVQLLESGGGLVQPGGSLRLSCAASGFTFSHYGMYWVRQAPGKGLEWVSSIYPSGGWTNYADSVKGRFTISRDNSKNTLYLQMNSLRAEDTAVYYCARRGSWGAFDIWGQGTMVTVSSASTKGPSVFPLAP

SEQ ID NO: 1247 - protein, 142 aa, Artificial Sequence
  Synthetically generated peptide
EVQLLESGGGLVQPGGSLRLSCAASGFTFSHYNMGWVRQAPGKGLEWVSRIGSSGGKTAYADSVKGRFTISRDNSKNTLYLQMNSLRAEDTAVYYCAKTNYDFWSGYLPNPNPYPLDYWGQGTLVTVSSASTKGPSVFPLAP

SEQ ID NO: 1248 - protein, 131 aa, Artificial Sequence
  Synthetically generated peptide
EVQLLESGGGLVQPGGSLRLSCAASGFTFSNYTMFWVRQAPGKGLEWVSSIYPSGGITRYADSVKGRFTISRDNSKNTLYLQMNSLRAEDTAVYYCARVSFWNAFDIWGQGTMVTVSSASTKGPSVFPLAP

SEQ ID NO: 1249 - protein, 140 aa, Artificial Sequence
  Synthetically generated peptide
EVQLLESGGGLVQPGGSLRLSCAASGFTFSIYAMIWVRQAPGKGLEWVSSIYSSGGPTQYADSVKGRFTISRDNSKNTLYLQMNSLRAEDTAVYYCRRRTYYYDSSGYYKYAAFDIWGQGTMVTVSSASTKGPSVFPLAP

SEQ ID NO: 1250 - protein, 129 aa, Artificial Sequence
  Synthetically generated peptide
EVQLLESGGGLVQPGGSLRLSCAASGFTFSHYAMFWVRQAPGKGLEWVSSIWPSGGKTMYADSVKGRFTISRDNSKNTLYLQMNSLRAEDTATYYCRGSYLAFDIWGQGTMVTVSSASTKGPSVFPLAP

SEQ ID NO: 1251 - protein, 131 aa, Artificial Sequence
  Synthetically generated peptide
EVQLLESGGGLVQPGGSLRLSCAASGFTFSYYQMSWVRQAPGKGLEWVSRIGPSGGLTSYADSVKGRFTISRDNSKNTLYLQMNSLRAEDTAVYYCARVGVWYGMDVWGQGTLVTVSSASTKGPSVFPLAP

SEQ ID NO: 1252 - protein, 133 aa, Artificial Sequence
  Synthetically generated peptide
EVQLLESGGGLVQPGGSLRLSCAASGFTFSHYAMGWVRQAPGKGLEWVSRIWPSGGHTQYADSVKGRFTISRDNSKNTLYLQMNSLRAEDTAMYYCATGYSSTWGAFDIWGQGTMVTVSSASTKGPSVFPLAP

SEQ ID NO: 1253 - protein, 131 aa, Artificial Sequence
  Synthetically generated peptide
EVQLLESGGGLVQPGGSLRLSCAASGFTFSRYWMAWVRQAPGKGLEWVSSIGPSGGSTKYADSVKGRFTISRDNSKNTLYLQMNSLRAEDTAVYYCARTARWLSFDYWGQGTLVTVSSASTKGPSVFPLAP

SEQ ID NO: 1254 - protein, 131 aa, Artificial Sequence
  Synthetically generated peptide
EVQLLESGGGLVQPGGSLRLSCAASGFTFSHYTMQWVRQAPGKGLEWVSSIYPSGGATKYADSVKGRFTISRDNSKNTLYLQMNSLRAEDTAMYYCARSGYYYGLDVWGQGTTVTVSSASTKGPSVFPLAP

SEQ ID NO: 1255 - protein, 131 aa, Artificial Sequence
  Synthetically generated peptide
EVQLLESGGGLVQPGGSLRLSCAASGFTFSYYLMGWVRQAPGKGLEWVSSIGPSGGTTKYADSVKGRFTISRDNSKNTLYLQMNSLRAEDTAVYYCARRGLGAAFDYWGQGTLVTVSSASTKGPSVFPLAP

SEQ ID NO: 1256 - protein, 131 aa, Artificial Sequence
  Synthetically generated peptide
EVQLLESGGGLVQPGGSLRLSCAASGFTFSHYNMTWVRQAPGKGLEWVSSIWPSGGATRYADSVKGRFTISRDNSKNTLYLQMNSLRAEDTAVYYCARTSRFYGMDVWGQGTTVTVSSASTKGPSVFPLAP

SEQ ID NO: 1257 - protein, 145 aa, Artificial Sequence
  Synthetically generated peptide
EVQLLESGGGLVQPGGSLRLSCAASGFTFSWYRMHWVRQAPGKGLEWVSSIWPSGGKTHYADSVKGRFTISRDNSKNTLYLQMNSLRAEDTAVYYCARALQYGSGSYFYAPKSYYYYGMDVWGQGTTVTVSSASTKGPSVFPLAP

SEQ ID NO: 1258 - protein, 131 aa, Artificial Sequence
  Synthetically generated peptide
EVQLLESGGGLVQPGGSLRLSCAASGFTFSHYLMMWVRQAPGKGLEWVSSIRSSGGITRYADSVKGRFTISRDNSKNTLYLQMNSLRAEDTAVYYCARVGYYYGMDVWGQGTTVTVSSASTKGPSVFPLAP

SEQ ID NO: 1259 - protein, 129 aa, Artificial Sequence
  Synthetically generated peptide
EVQLLESGGGLVQPGGSLRLSCAASGFTFSWYGMGWVRQAPGKGLEWVSVIRPSGGTTRYADSVKGRFTISRDNSKNTLYLQMNSLRAEDTAVYYCRGRYYSLDYWGQGTLVTVSSASTKGPSVFPLAP

SEQ ID NO: 1260 - protein, 128 aa, Artificial Sequence
  Synthetically generated peptide
EVQLLESGGGLVQPGGSLRLSCAASGFTFSNYHMQWVRQAPGKGLEWVSSIYPSGGFTRYADSVKGRFTISRDNSKNTLYLQMNSLRAEDTAVYYCARDGGQGGWGQGTLVTVSSASTKGPSVFPLAP

SEQ ID NO: 1261 - protein, 116 aa, Artificial Sequence
  Synthetically generated peptide
EVQLLESGGGLVQPGGSLRLSCAASGFTFSMYKMGWVRQAPGKGLEWVSSIVPSGGKTQYADSVKGRFTISRDNSKNTLYLQMNSLRAEDTAVYYCAKDITPGGGFGVPLAKLLLL

SEQ ID NO: 1262 - protein, 131 aa, Artificial Sequence
  Synthetically generated peptide
EVQLLESGGGLVQPGGSLRLSCAASGFTFSHYQMHWVRQAPGKGLEWVSSIRPSGGRTAYADSVKGRFTISRDNSKNTLYLQMNSLRAEDTAVYYCARVGVWYGMDVWGQGTTVTVSSASTKGPSVFPLAP

SEQ ID NO: 1263 - protein, 139 aa, Artificial Sequence
  Synthetically generated peptide
EVQLLESGGGLVQPGGSLRLSCAASGFTFSRYVMAWVRQAPGKGLEWVSVIRPSGGKTLYADSVKGRFTISRDNSKNTLYLQMNSLRAEDTAVYYCARVAGRVGVPATKKNWFDPWGQGTLVTVSSASTKGPSVFPLAP

SEQ ID NO: 1264 - protein, 130 aa, Artificial Sequence
  Synthetically generated peptide
EVQLLESGGGLVQPGGSLRLSCAASGFTFSWYVMTWVRQAPGKGLEWVSVIYPSGGATKYADSVKGRFTISRDNSKNTLYLQMNSLRAEDTAVYYCARRGAGGMDVWGQGTTVTVSSASTKGPSVFPLAP

SEQ ID NO: 1265 - protein, 131 aa, Artificial Sequence
  Synthetically generated peptide
EVQLLESGGGLVQPGGSLRLSCAASGFTFSRYRMVWVRQAPGKGLEWVSSIYPSGGYTKYADSVKGRFTISRDNSKNTLYLQMNSLRAEDTAVYYCARVITYNNFDSWGQGTLVTVSSASTKGPSVFPLAP

SEQ ID NO: 1266 - protein, 130 aa, Artificial Sequence
  Synthetically generated peptide
EVQLLESGGGLVQPGGSLRLSCAASGFTFSNYSMMWVRQAPGKGLEWVSSIYPSGGFTKYADSVKGRFTISRDNSKNTLYLQMNSLRAEDTAVYYCARVGFYGGFVWGQGTTVTVSSASTKGPSVFPLAP

SEQ ID NO: 1267 - protein, 129 aa, Artificial Sequence
  Synthetically generated peptide
EVQLLESGGGLVQPGGSLRLSCAASGFTFSNYTMTWVRQAPGKGLEWVSVIYPSGGHTTYADSVKGRFTISRDNSKNTLYLQMNSLRAEDTAMYYCRGRWFSLDYWGQGTLVTVSSASTKGPSVFPLAP

SEQ ID NO: 1268 - protein, 131 aa, Artificial Sequence
  Synthetically generated peptide
EVQLLESGGGLVQPGGSLRLSCAASGFTFSHYTMLWVRQAPGKGLEWVSSIYSSGGSTYYADSVKGRFTISRDNSKNTLYLQMNSLRAEDTAVYYCARVGVWYGMDVWGQGTTVTVSSASTKGPSVFPLAP

SEQ ID NO: 1269 - protein, 131 aa, Artificial Sequence
  Synthetically generated peptide
EVQLLESGGGLVQPGGSLRLSCAASGFTFSWYRMAWVRQAPGKGLEWVSYIGPSGGSTSYADSVKGRFTISRDNSKNTLYLQMNSLRAEDTATYYCARVGTFYGMDVWGQGTTVTVSSASTKGPSVFPLAP

SEQ ID NO: 1270 - protein, 131 aa, Artificial Sequence
  Synthetically generated peptide
EVQLLESGGGLVQPGGSLRLSCAASGFTFSHYLMYWVRQAPGKGLEWVSRIGPSGGWTKYADSVKGRFTISRDNSKNTLYLQMNSLRAEDTAVYYCARVGVWYGMDVWGQGTTVTVSSASTKGPSVFPLAP

SEQ ID NO: 1271 - protein, 142 aa, Artificial Sequence
  Synthetically generated peptide
EVQLLESGGGLVQPGGSLRLSCAASGFTFSNYVMYWVRQAPGKGLEWVSGIGPSGGFTTYADSVKGRFTISRDNSKNTLYLQMNSLRAEDTAVYYCTRDRYFGSGYYMAAYYYYGMDVWGQGTTVTVSSASTKGPSVFPLAP

SEQ ID NO: 1272 - protein, 145 aa, Artificial Sequence
  Synthetically generated peptide
EVQLLESGGGLVQPGGSLRLSCAASGFTFSMYKMGWVRQAPGKGLEWVSSIVPSGGKTQYADSVKGRFTISRDNSKNTLYLQMNSLRAEDTAVYYCAKDITPGGGSGFRLPKNYYYYGMDVWGQGTTVTVSSASTKGPSVFPLAP

SEQ ID NO: 1273 - protein, 131 aa, Artificial Sequence
  Synthetically generated peptide
EVQLLESGGGLVQPGGSLRLSCAASGFTFSHYKMEWVRQAPGKGLEWVSRIRPSGGVTKYADSVKGRFTISRDNSKNTLYLQMNSLRAEDTAVYYCTRGGLWDAFDIWGQGTMVTVSSASTKGPSVFPLAP

SEQ ID NO: 1274 - protein, 131 aa, Artificial Sequence
  Synthetically generated peptide
EVQLLESGGGLVQPGGSLRLSCAASGFTFSKYWMAWVRQAPGKGLEWVSVIYPSGGQTKYADSVKGRFTISRDNSKNTLYLQMNSLRAEDTAVYYCTLMRYGDRFDYWGQGTLVTVSSASTKGPSVFPLAP

SEQ ID NO: 1275 - protein, 131 aa, Artificial Sequence
  Synthetically generated peptide
EVQLLESGGGLVQPGGSLRLSCAASGFTFSRYVMSWVRQAPGKGLEWVSSIRSSGGRTMYADSVKGRFTISRDNSKNTLYLQMNSLRAEDTAVYYCARVGVWYGMDVWGQGTTVTVSSASTKGPSVFPLAP

SEQ ID NO: 1276 - protein, 127 aa, Artificial Sequence
  Synthetically generated peptide
EVQLLESGGGLVQPGGSLRLSCAASGFTFSWYAMMWVRQAPGKGLEWVSSIWPSGGHTKYADSVKGRFTISRDNSKNTLYLQMNSLRAEDTAVYYCATDQGYFWGQGTLVTVSSASTKGPSVFPLAP

SEQ ID NO: 1277 - protein, 131 aa, Artificial Sequence
  Synthetically generated peptide
EVQLLESGGGLVQPGGSLRLSCAASGFTFSNYYMLWVRQAPGKGLEWVSYIRSSGGSTRYADSVKGRFTISRDNSKNTLYLQMNSLRAEDTAVYYCAKPTVDGAFDYWGQGTLVTVSSASTKGPSVFPLAP

SEQ ID NO: 1278 - protein, 131 aa, Artificial Sequence
  Synthetically generated peptide
EVQLLESGGGLVQPGGSLRLSCAASGFTFSRYMMYWVRQAPGKGLEWVSSIYPSGGKTLYADSVKGRFTISRDNSKNTLYLQMNSLRAEDTAVYYCARVGVWYGMDVWGQGTTVTVSSASTKGPSVFPLAP

SEQ ID NO: 1279 - protein, 131 aa, Artificial Sequence
  Synthetically generated peptide
EVQLLESGGGLVQPGGSLRLSCAASGFTFSHYVMVWVRQAPGKGLEWVSGIRSSGGVTAYADSVKGRFTISRDNSKNTLYLQMNSLRAEDTAMYYCARVGVWYGMDVWGQGTTVTVSSASTKGPSVFPLAP

SEQ ID NO: 1280 - protein, 140 aa, Artificial Sequence
  Synthetically generated peptide
EVQLLESGGGLVQPGGSLRLSCAASGFTFSFYSMSWVRQAPGKGLEWVSRIRPSGGRTDYADSVKGRFTISRDNSKNTLYLQMNSLRAEDTAVYYCARDRLYYYGSGSYYYGAFDIWGQGTMVTVSSASTKGPSVFPLAP

SEQ ID NO: 1281 - protein, 133 aa, Artificial Sequence
  Synthetically generated peptide
EVQLLESGGGLVQPGGSLRLSCAASGFTFSHYIMMWVRQAPGKGLEWVSSIYPSGGSTIYADSVKGRFTISRDNSKNTLYLQMNSLRAEDTAVYYCASATEGYYYGMDVWGQGTTVTVSSASTKGPSVFPLAP

SEQ ID NO: 1282 - protein, 131 aa, Artificial Sequence
  Synthetically generated peptide
EVQLLESGGGLVQPGGSLRLSCAASGFTFSRYTMFWVRQAPGKGLEWVSGIYPSGGKTIYADSVKGRFTISRDNSKNTLYLQMNSLRAEDTAVYYCATGGVFGVVDYWGQGTLVTVSSASTKGPSVFPLAP

SEQ ID NO: 1283 - protein, 129 aa, Artificial Sequence
  Synthetically generated peptide
EVQLLESGGGLVQPGGSLRLSCAASGFTFSHYMMQWVRQAPGKGLEWVSGIGPSGGWTKYADSVKGRFTISRDNSKNTLYLQMNSLRAEDTALYYCARLNYGDYVWGQGTLVTVSSASTKGPSVFPLAP

SEQ ID NO: 1284 - protein, 131 aa, Artificial Sequence
  Synthetically generated peptide
EVQLLESGGGLVQPGGSLRLSCAASGFTFSHYKMMWVRQAPGKGLEWVSYIYPSGGWTGYADSVKGRFTISRDNSKNTLYLQMNSLRAEDTAVYYCARVGPWDAFDIWGQGTMVTVSSASTKGPSVFPLAP

SEQ ID NO: 1285 - protein, 129 aa, Artificial Sequence
  Synthetically generated peptide
EVQLLESGGGLVQPGGSLRLSCAASGFTFSHYYMAWVRQAPGKGLEWVSYISPSGGSTKYADSVKGRFTISRDNSKNTLYLQMNSLRAEDTAMYYCRGGTGTFDIWGQGTMVTVSSASTKGPSVFPLAP

SEQ ID NO: 1286 - protein, 140 aa, Artificial Sequence
  Synthetically generated peptide
EVQLLESGGGLVQPGGSLRLSCAASGFTFSYYEMEWVRQAPGKGLEWVSSIRPSGGRTVYADSVKGRFTISRDNSKNTLYLQMNSLRAEDTAVYYCAKGRSNYYGSGSYSPKYFQHWGQGTLVTVSSASTKGPSVFPLAP

SEQ ID NO: 1287 - protein, 131 aa, Artificial Sequence
  Synthetically generated peptide
EVQLLESGGGLVQPGGSLRLSCAASGFTFSHYAMDWVRQAPGKGLEWVSVIYSSGGKTTYADSVKGRFTISRDNSKNTLYLQMNSLRAEDTAMYYCARVGVWYGMDVWGQGTTVTVSSASTKGPSVFPLAP

SEQ ID NO: 1288 - protein, 128 aa, Artificial Sequence
  Synthetically generated peptide
EVQLLESGGGLVQPGGSLRLSCAASGFTFSHYLMHWVRQAPGKGLEWVSVIYPSGGTTKYADSVKGRFTISRDNSKNTLYLQMNSLRAEDTAMYYCRNSGSHDYWGQGTLVTVSSASTKGPSVFPLAP

SEQ ID NO: 1289 - protein, 127 aa, Artificial Sequence
  Synthetically generated peptide
EVQLLESGGGLVQPGGSLRLSCAASGFTFSNYLMGWVRQAPGKGLEWVSSIGPSGGYTKYADSVKGRFTISRDNSKNTLYLQMNSLRAEDTAVYYCRTGTTFFWGQGTLVTVSSASTKGPSVFPLAP

SEQ ID NO: 1290 - protein, 131 aa, Artificial Sequence
  Synthetically generated peptide
EVQLLESGGGLVQPGGSLRLSCAASGFTFSHYVMVWVRQAPGKGLEWVSSIYPSGGMTVYADSVKGRFTISRDNSKNTLYLQMNSLRAEDTAVYYCARRGIANSFNIWGQGTMVTVSSASTKGPSVFPLAP

SEQ ID NO: 1291 - protein, 142 aa, Artificial Sequence
  Synthetically generated peptide
EVQLLESGGGLVQPGGSLRLSCAASGFTFSPYFMEWVRQAPGKGLEWVSGISSSGGNTLYADSVKGRFTISRDNSKNTLYLQMNSLRAEDTAVYYCARDRFGNYYGSGSKLQHDAFDIWGQGTMVTVSSASTKGPSVFPLAP

SEQ ID NO: 1292 - protein, 131 aa, Artificial Sequence
  Synthetically generated peptide
EVQLLESGGGLVQPGGSLRLSCAASGFTFSYYMMGWVRQAPGKGLEWVSSIYTSGGYTKYADSVKGRFTISRDNSKNTLYLQMNSLRAEDTAVYYCARASIYYGMDVWGQGTTVTVSSASTKGPSVFPLAP

SEQ ID NO: 1293 - protein, 133 aa, Artificial Sequence
  Synthetically generated peptide
EVQLLESGGGLVQPGGSLRLSCAASGFTFSNYKMHWVRQAPGKGLEWVSSIYPSGGWTVYADSVKGRFTISRDNSKNTLYLQMNSLRAEDTAVYYCATGYSSTWGAFDIWGQGTMVTVSSASTKGPSVFPLAP

SEQ ID NO: 1294 - protein, 131 aa, Artificial Sequence
  Synthetically generated peptide
EVQLLESGGGLVQPGGSLRLSCAASGFTFSRYPMIWVRQAPGKGLEWVSVIYPSGGMTKYADSVKGRFTISRDNSKNTLYLQMNSLRAEDTAVYYCARVGSYGSLGYWGQGTLVTVSSASTKGPSVFPLAP

SEQ ID NO: 1295 - protein, 131 aa, Artificial Sequence
  Synthetically generated peptide
EVQLLESGGGLVQPGGSLRLSCAASGFTFSNYKMSWVRQAPGKGLEWVSGIYPSGGLTQYADSVKGRFTISRDNSKNTLYLQMNSLRAEDTAVYYCAKVGVWYGMDVWGQGTTVTVSSASTKGPSVFPLAP

SEQ ID NO: 1296 - protein, 129 aa, Artificial Sequence
  Synthetically generated peptide
EVQLLESGGGLVQPGGSLRLSCAASGFTFSHYTMWWVRQAPGKGLEWVSRIWPSGGTTRYADSVKGRFTISRDNSKNTLYLQMNSLRAEDTAVYYCRGSYLAFDIWGQGTMVTVSSASTKGPSVFPLAP

What is claimed is:

1. An antibody comprising an immunoglobulin heavy chain (HC) variable domain sequence and an immunoglobulin light chain (LC) variable domain sequence, wherein the HC variable domain sequence and the LC variable domain sequence form an antigen binding site that binds to hK1 and inhibits enzymatic activity of hK1 (SEQ ID NO:1021) with a Ki of less than 10 nM, said HC variable domain sequence having:

a CDR1 that comprises an amino acid sequence: Xaa1-Tyr-Xaa2-Met-Xaa3 (SEQ ID NO:31), wherein Xaa 1 is selected from Lys and His; Xaa2 is selected from Lys, Val and Ser; Xaa3 is selected from Val, Ile and Thr;

a CDR2 that comprises an amino acid sequence: Xaa1-Ile-Tyr-Pro-Ser-Gly-Gly-Xaa2-Thr-Xaa3-Tyr-Ala-Asp-Ser-Val-Lys-Gly (SEQ ID NO:32), wherein Xaa1 is selected from Ser, Trp and Arg; Xaa2 is selected from Ile, Asn and Arg; Xaa3 is selected from Ala, Ile and Gly; and a CDR3 that comprises the sequence at DITPGGGSG-FRLPKNYYYYGMDV (SEQ ID NO:12); and said LC variable domain sequence having:

a CDR1 that comprises an amino acid sequence: Arg-Ala-Ser-Gln-Ser-Xaa1-Ser-Ser-Xaa2-Xaa3-Xaa4-Xaa5 (SEQ ID NO:284), wherein Xaa1 is selected from Ile and Val; Xaa2 is selected from Tyr and Ser; Xaa3 is selected from Leu and Tyr; Xaa4 is selected from Asn, Ala and Leu; and Xaa5 is Ala or is absent;

a CDR2 that comprises an amino acid sequence: Xaa1-Ala-Ser-Xaa2-Xaa3-Xaa4 (SEQ ID NO:314), wherein Xaa1 is selected from Ala, Asp and Gly; Xaa2 is selected from Ser and Asn; Xaa3 is selected from Leu and Arg; Xaa4 is selected from Gln, Ala, Ser and Thr; and a CDR3 that comprises the sequence QQSYSTPLT (SEQ ID NO:9).

2. The antibody according to claim 1, wherein the antibody has a Ki for hK1 (SEQ ID NO:1021) of less than 1 nM.

3. The antibody according to claim 1, wherein the antibody has a Ki for hK1 (SEQ ID NO:1021) of less than 0.1 nM.

4. The antibody of claim 1 that comprises LC CDR1 of SEQ ID NO:7; LC CDR2 of SEQ ID NO:8; LC CDR3 of SEQ ID NO:9; HC CDR1 of SEQ ID NO:10; HC CDR2 of SEQ ID NO:11; and HC CDR3 of SEQ ID NO:12.

5. The antibody of claim 1 wherein the heavy and light chain variable domain sequences are identical to corresponding variable domain sequences of SEQ ID NOs: 1240 and 1159.

6. The antibody of claim 1 wherein at least 80% of the FR regions are identical to FR sequence from a human germline sequence.

7. The antibody of claim 1 that is humanized.

8. The antibody of claim 1 that is a full length IgG antibody.

9. The antibody of claim 1 that is an antigen binding fragment of an antibody, and does not include an Fc domain.

10. A pharmaceutical composition that comprising the antibody according to claim 1 and a pharmaceutically acceptable carrier.

11. The antibody of claim 1 comprising a human FR1, FR2, FR3, and FR4 in the heavy chain variable domain sequence and a human FR1, FR2, FR3, and FR4 in the light chain variable domain sequence.

12. The antibody of claim 1, wherein the heavy chain variable domain sequence comprises SEQ ID NO:1240.

13. The antibody of claim 1, wherein the light chain variable domain sequence comprises SEQ ID NO:1159.

14. The antibody of claim 1, wherein the antibody comprises a heavy chain encoded by the sequence of SEQ ID NO:146.

15. The antibody of claim 1, wherein the antibody comprises a light chain encoded by the sequence of SEQ ID NO:145.

16. The antibody of claim 1, wherein the antibody comprises a heavy chain encoded by the sequence of SEQ ID NO:146 and a light chain encoded by the sequence of SEQ ID NO:145.

17. The antibody of claim 1 that is effectively human.

* * * * *